United States Patent 11,058,709 (METHODS OF TREATING BREAST CANCER) - sequence listing, part 2

SEQ ID NO: 243 - DNA, 35096 bp, Homo sapiens
tagtgaaggcagaccacaggctggcaaatggaaatgcatgatgcttcctaaggcctaggctcagacctggcaactgtcaattccactttcctcatcttatgtaagtagaaactctaaagcaaatctgcacaaggaatgggattctgggaaatgtagttcccagccttagatgcctatagtgatggtggtaaaggtgagggtgatggtgtgatggtgatgggtagtagcggtgatgatggtggtaacagtggtggtaatgatggtgatgatggtgacagtggtagtgacagtggtggttatggtggtgatggtggtgatgctgttggtggtgatggtggtggtggtggtgggtgataatggtggttatggtggtggtggtggtgggtggtgatggtggtagtgacagtggtggttttggtggtgatggtggtagtggtgattatgctggtggtgaaggtgaatggtggtggtaatggtagtgatgtgatggtgatggtgatggtggtggttatggtggtgatggtggtggttatggtgatgatggtaccggtagcagtgatgtgatggtggtggttatggtgatgatggtaccggtagcagtgatgtgatggtggtggaggtgcagtggtggtggtaacaagctgaaaatagataattaagcgcagtatgaaaatgttcagtccctgagcacctttctagacataaggttgaaacaacttctatactttctagaattcaattcaaagggaaacatgatcacagaggctgtaagattcacttagggatgggtcatttataattcattggggagcaggttctttttgtgtgaagttttatcttcatcaatttcaatcatttctgttttttatctgatgattccactgttttctctgttttctttttctgtcacacttatgtctcatcatatctctcatttttttcatctttttatgtttgggaaaaattttcctgactccacctttatttttaaatctcaaatagttgttcttttccatttctttctttttcagaatattttgttcttggtttatgtactaaaaattttacatctctctattaattggaatattattcttagatattttctgtatcctaaattaccatattttttctgtttatatttttttctgtttctttgttcaggtctttcttgtttgagctagaaatcaaaaggtatctgagacaaatgtcaatcaatttagaagtttattttgccaaagttgaggatgcacccaggaaaaaaaaacagaagttacagtaggatctgtggcctgttctttatccgaagagagtttcatgaacatcaatatttaaaggcaaaagagcagacaggagtgaaaggaggaaagaaaaaaaaaaaaggagggcaggcaatgaggcaagcagttacattcttgtgaggctctgattagtgctcactgcatcgacattttacataaaaagagaggagtagggggaaaagtcaataatgcattcctctcgagctcagtaaatctacattttacataagataaagttagcatgtgaaattacagctctctgggaacaaagaaaggcaggttttgtttgtttgtttgtttctgttatatgtattttgttttgttttgttttttgtgaatcagttcacaggctgaatttttgcctctggcatagtgactttggggtcttaagattttatttttcttgcacagagtttaggtctcctcctctgcctggtgattcttggtcttctgtttgggattgagaaaacaggatgggtatgtggtgttggttctctctgtggctgagtctctatggtatggtgggtgtgttcaattattttagaaaataggctacagtggtttctcttggaacatctacaggccacctcttctatggatcaaggagtatatattctttgtgaacttgtgacttatcaggactttaataacccccctgcatacccagttaacatattctaggaagttgcttcaccacacgtttcattagccaacacatttccctctaactagcagtgtctgcattttccattaaataatccatgacttctcatactatttgcctttgccaacttcatcacatattcaaactccttctctaataatagggctatatgaactaaaaatcaacacagctttatggcatttttaatatttggaaaagtcatttcccctcataatactttctttcaaaacatttaaaatttattctcaacacttttttcttccacatgaactttggatttattttaacaagttttcccaaaaatagtatagagactttgtttggaattattttaattatgtaagttgggaaatttaatcatacaaaatagtcttatcatccaagacatgttatgtaaatattggtattacttattttttggtgtgtaataatagtatctataattatttgtatgttttccaagtggttatagacattataaagacctgattttttatatattactttcagaatcagccactgaattctatccacaatccatatgttattttgattgacaatctggggtgtttatatacaatcatactggctgcaaatagtaatacttctatcttcttcatatcaaatgtatattacttgtttttgtcttctgtccagagcctccaaagtaacattgtaatgtgttgataggaatgagaaacgaagaccttcactaagtttatttttctacagtttccctattccttgactacactgggcagaggtatttattgtctttgcaaataaatcattttttgtttcacttattaatcccatcatcttaaaagtcattaatttctgatttcatctatattatgttctttctaattccctacgttgaaggataacatatattttttttcttcttcatttggaaatgaaagcatttagggttaataattggcctctcccaataccttggaaagccttagttacatagtgtcttcctttttaataattttctaaatatactgaaataatatttgatatcctattagttatctgagagggcttttattttatttgttatatcttaactaattgggttattctttctaaatgtttattataaatcttgaattttagaaaattatgttcacgaataacaagttttgctctgaggattttatagaggcaaatatatgcaacttttgtaaatgttccatggacattcaaaaattagtagtcctattagtacgagctttatctttatcttttctaagtcttacattatcattgtgataggctgaacagtggccccttaagatatacaggtcctaatccctcaaacctttggatattactttataagacaagactttgcagatgtgattaacagtattgagatgggaagattatcctgaatcaacttaaaggaaaaaaaaactgaggcaaaattaataaaagtagagagtttatttgggccaaatttgaggactgcaacccaggagcatagatcctaattgccctgaatctacattctaattaacagcagttacaagtcggattttaaagaaaagaaggagaggcagttcctaagctgttcaccaacaatttacattaaaataacatagtctattgaatggctatacattgtcttttgtatcactaattccaggaacaggatataagggtgagacatctggtctgaaatgcttttaaacaattgcccccagcataggtgtggaagggcagggtgagactgaagccctgtgctcaagtatctctgagcctggtaagttctgcccacatcgttcagactgctctcagctatttttcttttctcacctggattatccaggtatgccctaaatgcaaatcacaagtattcttacaagagggaggcagagagagatttgatagagaagaagaaggccttgtgaccactgaagctggatgctatgctgctggctttgaaggtggagggaggggccaggagccagggaatgtaaggaatgcagctccaagctagaaaagacaagaaagggcaggaaaacaggtcctccccagagcctctggagacggtgaggccctactgacatctccatttcagcccagtgaaactgattacagccttctgacctgcacaattgtgagacagtcaatatgtgtcattttaaaccatcacatttgtggcaatttgttatggcagccacacgcaactaattctcttttcattgtttcctgatctaccatagagtagtggtactgataaactctccctaatagttgtattttgatcatttcttcttgacttttaaaatgtgaatatacagtgccagtactgtgtttctcagcatatgaaggctaaggaccatttttactgctaatacctttcataacacaacatgacttttattgccactttaaggctccttgagttgatgcctacattttcttcatattgaaataatcgtttcctctgtcatgtgaactttcctgtctatctttccccagtcttttattttaaattgtaaaagagctctccttaatatttatttcttgtatcatatcctatttttgcttcctattataagactttgctttgatatagcggaatttaaactgccaacatttatcatcataacgaaaatgcttgacccttatgcctctcatcttgctttgttaggctttccattgtatactttactgtagctttcttttatattcatgttatttgtacgatggtatttttaaaaattataccaatgaatacttttaatttttaaaatatctatttaaatgtgttctctaattatctaagtccagaataaagcaattattttgactcctttttacataagacttaaaatttattacactttatctcttcctatgcacttgattatttcctagtctttgttaatttactttcacattatagacctagatcgacgtatattatcattgctatttttaataaagtaaaaattatttgagattttttttctctttttaggccattttaatgtaactcatttattcatccaataaatatttattgaggacctatactatgagccagatgctgagctaagaagtggcagagccttagtgatcaagaccacacagcctctgcctaggcctcatgggctgtggtgctgtgtggtctctgtgttcgatccatttcagttctcacctaccctgtgttcaggccaccctgaactgggcttggttctttagaatcaccgtacctaccatgttaccaagccaccatgccctaaagccaccatgccactatgcccctataccaccatgctaccccattaccacaccaccatgtcaccacgccaccatgccacccatgccatcatgtcaccatgctaccacaccatcgtgccatcattccaccatgtcactatgccacacatcaactcaccaccatgccaccataccaccatgacatcatgccaccatgctgcaatgtccccatgtcaccacctcaccacaccaccatgccaccacatcatcatgccaccatgttaccatgccaccacatcatcatgccatatcacgtcacacaccatcatgccaccatatcaccacatcattatgccaccatgccacgataccaccatgtcaccatgtcacaacatcaccatgacaccatatcaccatgccaccatatcacatcttgccacaatgccatcatgtcacatcaccatatcaccatgccacatcaccatgccaccatctcaccatgatatggtgagatgttacttactgtaccactgtgtcatgatgcaccctgtcatactgaactatgttatcaagttaccacaccaccatctcaccctgtcaccatcccaccatgcaccatgccactatgttacctgtctcctggtaggtgtttgcctgtttatttccctcttgtcccttggactgtgggcttcacaagggcatggacctttctggttttgttcaaaattttgcttactagcacaatgccttggcaccttgcaaccattcaataaatgtttattaactaaaggggtgactaagtaaggtgctctttttttggtaattaattctttatattgattgcttttatgttggctagaatatctcttaactaattataaaagagaatgtgaatggtcattttctaatccccaatgtaaccaaggatgaccctgtgttgtaaaagtgtggctgggtatgatagtctttgtacctaactttgactcaatttttacctcttagaagtgtgtgaatttggggacatcatcccctggcttttgcagaaatgtctgatgtcagattaatttttgtttgtttttaaataatctgccctcttttctcttttgtctaaatatatgtgaatttttatctttttcctttaaaaaaatcccatgtagtgtgttggtcttgcctagtatatggtgagtgttcttccccctgtggattaaatgtttgttctacccagagaagttttcatgaattacaacctcccttgaactaccctgtccacgtgcaggtggccaagtgaccttcccccacccaccaccatgtcgagaactagagctcaaagatatagaggaggaataaaggtagatgaaagtaggaacaccgctgatagcttcagagatagtccttgtgcagtgaccttgtgcagtgagagggtgtccgctctgttttctgattaatgtggactcaaacaaagatcacccagggggtcaaagtcttttcctaccttctctgggacctgctatgctgatctcatgcagcggacttgggggaattccctgtgttcctcaattaaacccaagctctgctaaaatatacaaatagtcatcctaaactctaggtccaacattggcctagaaactctaggtcctaattttccaagctgttagatgtttttattttccggattttttttttttttttttttttgagacggagtttcactcttgtcgcccaggctggagtgcaatggcatgatttcagctcctgctcactacagcctctgcctcctgtgttcaagcgattctcctgcctcagcctcccaagtattacaggtgggattacaggtggccaccaccatccccagctaatttttgtatttttcggaagagatgggtttcaccatattggccaggctggtctcgaattcctgacctcaggtgatcctcccacctcagcctcttaaagtgctgggaatacaggcatgagccaccatgcccggcctgtttttgggatattttaatggaaagtgatggagtatgaatccggcctgctcaggtagctctaggtcagccatgaaatctacgtcctgataaggagcctggagaggcttcctcaaatccccaggccatggcattgccagcgcaacacttgcatctcctgacttagcccagcactgccaagcagacctcatgggtgtccttctgccaccttcgtgcttcctccatcctggtctccctgtctgtttacatcagtgtttctcttggcccagggcagggtctctttatctcacggcctctgtggtccagttagttaggagagagttttgagcaggtgcaattagtgtggagtctctggggcctgcactcacacacgcgggatcctgacaagccctgagtcctggaacagccgcaccctgcagtagcacccacggagcagcctttaggccctgatgctcctttcaaacaatcagaagcttctgtgggccagagccgtccatagggcctttgagagcctggggaggtagaagggagagtgaggcatccatagcagtgtctgcagggaaaggggggtttacctgtcccctggcacagttagatgtgtagctcacgctttgactataggatgctcttatgtgtccacacttcacaaagcacagggcagctctgtgttgttgcccagaagaaaatgaacccccccccgcaacttccactatatgaattctctgcatcgctgcctctaggcagcaggacagccagcagtaagctgcagacatcccaccatgctgcagcttgctgtctgcagcaggaagccccacatacagcctgacagtcaggccaagccatttggccattcaccagtgctgcaagctcaggcaggttgcttaacctgtctcagttcctgcttctgagaagtaaagctaatggggtctatgtcatgagattactggaagattaagtaaaataacaagcatcaggcagctgacacagaaagtgtgcctgagaggtggatggatggctccctagcccctctctttgtcttctgggctgagcccctcccgatccccacagggcaaaggctggctgattttcagtagtttaagctggtgtgtagcagctaaactccacatttctagaccgtttgaacaggaaacctgagatgagggagcgtttgaattggctcatgcaaaaaacaatatttgctggaggttagctgctgcattatgaatttttaacctcccataaatcaaactgtaaaaatggacaaaggctgagtttcctgtgccaggaccaaaatagacaccgcctgcgtctcttagacaattccgattatgtttccacaaccaaatcatgctgagatgaatagctggaatatttatatttaggtcctaacgtataatgtaaaataaatgaaaacagtctatcttcttggcactgaaattgtgccaccatatccatttacaaagacgataactcaaagaccaggctgtgcaaagaccatcatgtgcctggggcgggattttgcttctctgctcccattgcttttccctacgaccgtcgtcaccagatacccaatactaaatgattaatagaaaatccccagcgggatcagtccacagcaaggtttaaagtgaatccttttgtgaatgctttatactgacaaatacaaatgctttaaaagatccaggagatggaaccttgtaactgcagaggatggtattttaactaaagaaagcttttattaatttgacaaacatatctttccctggcaactcctatgagctacaaacttagacgaatatcataacaactaagagatttttattctttcaatttagtggtaaagggaggtattaaagcacctgatttactatgaggcagaaagaaacatgagctcgagtgttacaagcaaatgttacagacttctagaaggaaagaccgcaccaaaaaagtgaagttggagctgaactttaaaggatgataaaggttttagtatggaaaatagagctccagaggccaagagaaatgtggctacactgaggtgaaactggcaatagggtgtggagtgaaagtatacgatacaaaaaataaactgaaagcaagtatgggccaggcacagcggctcacgcctgtaatcccagcatgttgggagacccacgtgggaggatcacttgaggccagaagtttgagaccagcctggcccacatggcaaagccctgtctctactaaaaacacaaaaattagccaggaatggtggcacacaccagtagtcccaggtacttgggaggttgaggcaggaggttcgcttgaacccaggaggcagaggttgcaatcagcctagatcataccactgcactccagcctgggtgacagagcaagactcggtctccaaaaaaaataaagcaaagtatgaagcaatttggaataaggaagatagagccttataggagactggaggtttttaaaggcttctaacaaaagggctgatgtgatatcagcagtgtgaatgaatcgattcattcacttaacaaatatttacctagctcctcagtgagggatggagtggtaggtaacaaaaccaataggctcctgcccccatggacccacagtttcatggggtgacaagcattaacaaataaacctgtaagtaaatgtattaggttgatgcaaaagtaattgtagtttctccattacttttaatgcaattacttttgtgtcaacctaatataattacaggcagaagagagaactaggtaagaagggtgcttagggtgatgtccaaggaagcagggagccctgactaatactgggggttggagagaggagagaaggcattgctgaggacctggcatccacactgggtcctggggggtcaatggagttggaaagcagggctatgctggggccagggctgcagcagagattggaagcattccaagtgcaggactaggaacaaaggccttttggcaaatgaagaggtaggcattttcaagaaaacaaaagagaagagagtggcataagataactccagggggatgggacatctgcagggcctggcaaggcacattcaggattttatttttatttatttatttatttatttatttgagacggagtctcactctgtcacccagggtggagtgcagtggtgagatcttgactcactgcaacctccacctcccaggttcaagtgattctcctgcctcagcctcccgaatagctgggactgcaggcatgtgccaccacacccggctaattttttgtatttttagtacagatggggtttcaccgtgttaaccaggatggtctcgatctcctgaacttgtgatctgcccacctcggcctcccaaagtgctaggattacagacataagccaccatgcccggcccaatttttgtatttttagtagagatggggtttcaccatcttggccaggctggtcttgaactcctgaccttatgatccacacaccttggcctcataaaagcgctgggattacaggcatgagccattgcacccggccacattcaggattttaatcaggaagtgcaaggggaagccactgtctggagtgataagatctggttggttgaataacgtccctctggctgctgtatggaaggtggatctcagaggagtgagtctgaaagacattgtggtgatcctgaggactatcatctgatttttttttatcttgtccgaatttctatctcaagggtctggggagtcatgttctacaaatcataaattctcatcagatgggtttaatttaaccctatataggatgacttactttccaacctgactctggcataacattatgagacaaggaagaaaatcaaaatattttaccccaaaacatgtttctttgccatatcttgaaatggccctgcaaagctgtcctttgtgggggaaaatttgcatctataaagaatctctattaacctagctagttctttttcttcaagaccctcccaatcctaaagagattaactaaaagtctagcaccttctaaagatctgaataggaaacatttgtcatctgttatctctaaagggcagccaccataagacttcaaaagaaccttggtcttcacaatcttttatcttaacccgaacatttcctttctgtgatcccaggtctttagataaactcaaccaattgtcaaccagaaaatgtttaaattcacctatagtctggaagcccctgctttgagttgttctgcctttctggatcaaaccaacgtatttctttaatgtatttgattgatgtctcatgcctccctaaaatgtataaaaccaagctgtgccctgaccaccttgggcacatgttctcaggacctcctgagggctgtgtcagagaccatggtcactcatatttggctcagaataaatctcttcaaatattttacagagtttgactcttttcattgacaatgtgaaggagatatgcagcagtttgcacagagcagtcctggtgaaccaggaggcaagagggcaatttaagacctccttcaaagttacagcagacagatcttgctgatgggttgggggttgggagcagtagaggagggaaaagtcaaggagattccatgttctgacttgagccactgagcagaaggtggtagtttcccagagatggaaaagcctaaagtaatgttaatgcgtaggctgcaggtgagaggtcaagaaatcagcttgagatttggaaacactgaatgcctatgagacatccaatgcagaggtcaagtgggccattcacaatatgagtcagaagctcagaaaaatgaaaacaaccacagatcatctgggaggagggcagagtagaggcaacagctagaaagggcagtttccatcttggcttcctgtgcctgggatctgccccagctgacctttccaggaagtctctggtggtcacctgccgaccttatcacaaagctctccaaaacacatcaaccttaatttcaggttcaggttcacccaagaagaaaaacagtaggcttttgtcttatatccttttgcaatcacttacccttctccaaatctgggccccaagcaattatgagtttactttctcttgcgatagcttagctttgcctgttctcctcctcggttctttgaatgtgcctataataatctccaacaggtttctttgatattatgacaaattctagacacatcctgcattttccttgactgcagaatctgtattaactcttctcaagagccctggttcctttttgtgggaaatgatatgtagagaccacaatctgggttcaaagggtgctaattaatagtgattcattgttactaggccttttataaagctaggaaatttctgactgggcgtgttggctcacgcctgtaatcccagcactttgggaggctgagacaggcagatcacctgaggtcaggagtttgagaccagacttgccaacgtggtgaaaccctgtctctactaaaaatacaaaaaattagctggacgtggtggtgcatgcctataatcccagctacttgggaggctgaggcaggataatcacttgaacctgggaggcagagattgcagtgagctgagatcacactactgcccttcagcctgggcaacagagcgagactctgtctcaaaagaaaaaaaaagggctagggaatttctaaaaattaagataaaacacttcctaattcatactgctagcttccgatccagattctggatataggctttttactaaaattgattaatcttacttctattcttttttctcccacacagaaaattctggttctcaatgacaccagcatcattactgatttgctttctactcacacacaaatagcctccaaataagaatgccaacactatcaccaaaaaggtaattgctgaaaactgtttaagatctttagcaggtttttggtgggaagggcttgggggtttgggaggttggtttggcttttttttgtttgtttgtttggttgttgtttttttttttggtcctgacattatatcccacttggaatgtatactgtaattaccatatttggaaaccacttgaaatagtttctctttgtgtggtacgacatcaaatgcatacatcatgaaatttgttctattttgccttctatttttatgaatggttttaatggtggttttgttttgcaactatgtaaaaatatgtacatgtcccaagtcaaattccaaaaacaagacatattcaaagaattttagcttctctacctgctatccctttcctctagtcaaattccaaaacgagatatattcaaagaatttagcttctctacctgctatccctttcctctgagatagcgtttttttaagatttataccagcactgtttttacacatgcacatgtgcacacacacatacacatattccttgtattagctcattttcctactgctataaagaaataccaaagactgggtcatttataaaggaaaacaggtttaacagactcagttccacctggctggggaagcctcacaatcatggcggaaggtgaagaagaagcaaagacacgtgttacatgacggccgtcaagagagaagtgcagcatgaaatgggggaaggccccttataaaaccatgagatcttgtgagaactcactcactaccacaagaacagtttggaggtaacaactcccatgattcaattacctcccaccaggtcccttccacaacaagatgagatttgagtggaaacacagccaaacaatatcattctgcccctggcccctcccagatcttatgttcttacaattcaaaacataatcatgcccttccaatagtcctccaaagtcttaactcactccagcattaactcaaaagtccaagtcgaaagtctcatctgagacaaagcaagtcccttcaacctatgaacctgtaaaatcaaaagcaatttagttacttcctagatacaatgggggtacaggcattgggtaaatacacccattccaaatgggaaaaattggccaaaacaaagagtctgcaagccctatgcaagtccaaaatccaatagtgcagtcattaaaccttacagttccaaaatgatctcctttgactccatgtctcacatccagggcacactgatgcaagaggtaggctcccatagcctttggcagctctgcccctgtgcctttacagggtacagcccctctcctggctgctttcaccggcaagcattgaatgtctgtggcttttccaggcgcatggtgcaatctgtcagtggatctaccattctggggtgtggaggacagtggccctcttctcacagctccactaggcagtaccccagtgggaactctttgtgggggctccaaccccacatttcccttctgcactgccccagcagaggttctccatgagggccttgcctttgcaggaaacttctgcctggacagctaggtgtttccaaacaccctctgaaatctaagtggaggttcccaaacctctgttcttgacctctgtgaccctaaagactcaacaccacatagaagctcccaagatttggggcttgtaccctctgaagccacagctggagtggctaggatgcaggacatcaagtcctgaggcttcacacagcagggaggccctggacacagcccaggaaaccattttttcctcctaggcctccaggcctgtgatggaaggggctgctgcaaaggtatctgacatgccctggagacattttccccattgtcttggtgattagcatttggctcctcaccacttatgcaaacttctgctgccagcttgaatttctccccagaaaatgagtttttctctcctagtgcatcatcaggctgcaaatttttcaaactcttatgctctgcttcctcttgaatgctttgctgcttagaaatttcttccaccagataccctaaattatctcccttaggttcaaagttccacagatctctagggcagggcaaaatgccatcagtctccttgcatagcaacagtgacctttgctctagttcccaacaagttcctcatctccatctgagatcacttcagcctgggttttattgtccatatcactatcagcattttggtcaaagccattcaacaagtctctaggaaattccaaactttcccacatcttcctgtcttcttctgaaccctccaaactgttgcaacctctgcttgttacccagttccaaagtcgcttccacattttcagaaatcttaatagcagtacttcactctaccagtaccaatttactgcatcagtccattttcatactgctatgaagaaatacccaagactggataatttataatgtgtaaaggaaaagaggtttaatggactcacagttccacatggctagggaggcatcacaatcatggcagaaggcaaaggaggagtaaagccatgtcttacctggaggcaggcaagagagaagtgcagcatgaagcagaggaaaagccccttataaaaccatcagatcctgtaataactcactatcacaagaacggtatggtggtaactgcccccatgattcaattaactcctactaggtccctcctatgacacatggagattatgggaactacagttcatgatgagatttgggtggggacacagccaagccatatcattcctattacctttctgagatatatggaagcatattgtatgtaaacatattgttctctttgttctcattgcctaatatgactgcactgtggcctctgatcctcttccttccttttacaccctaatgctccattacatggaagcaccactgttattcaaccagtcatccatccatgaaaatttgtcatttgtaatcttccattattataaatagggttgcaataaatagtcttgatcatttgtctttttgtatttctgctagcaccactcatttttagggcacttactacattccaggccttaataatataccggcgggaagacataaatccctgctgctatgatcgaaatatttgtctacccccactcctaaatgtatatgataaaatgatggtattagaaagtggggcctttgggaggtgaggaggtcataaaggtggatccctcatgactggaattagcatctttataaaagagaccctagggagccacctcaccctgtctgccatatgagaacacagccagaaggcatcatctgtaaaccaggaagcaggttctcaccagatacagaatctgccagaacctccatcctccagaaccgtgaggactaattttctgttgtttataaacacctagagtgtggtattttgtcatagcagcccagatggactaagacacctgcccttaagaagtcctcattcttttggggttgggggaagaaggacattacagagaatctgttggaatgtggtaggggctctgaggaaaagtaaagctgggtaaaggggataggagccatgggatgggggtgggcgttctagcctattcagataagtcccctcggataatagggcagttcagcagaaacctggaggaagtgagggagtgagccacaaaggctccaggaagaggaacagcaaatgcaaagagaagcacacctgaaataggaacaaatcataggccagtgagactgcagcaaagtgagtgaggggaggtggtgggagagcagatcagaggcatggctgtggcctggatcatgaggctcacggaagggtatggtgcattccagaaggcccaggcacaggtaaggcaggcaactgtctgggagccccagcccccatacccaagcacccaagcccagcaccacactcccgaccagctccccaagactttgaaacttcaagcccattcccatcatctgtggcactggccctgcctgctcaggcctgggtagcagagtgcacaatacatggaatgtctgggcaggccaccatgggacagagcacagaggacacccatacagcagctgagaatgaccacaggccctctggacccagtcgccggctgctcccaaagctgtctgctccttcagtgtccagctatgccatctaccccagaagattcccccttggcttgatgacctggttgcagcatttaccttggtacacaatttgtattgttttaggtgattaaaagtaattctcaccaactccacatgccataagcctgggtaagaaatgccccacctggtgcactcccaggccccaagccctatgctaattgactattcaaggcattctctggcacccactcactcactatgcctcagttcccacctgtaggttagcaaatatgtcatgggacaccaggtaagcgtgactttgttgaggagttaagctgaggaggaaaactgaagtcaggataggcatacagtgggttctctgacttttgaatccttttggccctggtttcctcatttaaagggatgaggataaaagactggttcctgtatcataggatacatacatatcataggataaatgttaactgtcacacatgtagtggagtgatgtctaatatacactatgtgcagaaaatgtgttacacgatgacagtgatttttattatcattaccatacatggtgtcttagttcttttggactgctatagaaaaatatcataaactgggtagccgataaacaacagaaatatattttggatagctctggaggctgggaagaccaagattagggcaccagcaggttccatgtctggcaagggcccattttctggttctgagacagcaccttctcactgtgtcctcatggggtggaagtgctgagggatctcttaggggcctctttgagaagggcactaatcccatttgtgagggctccagtcccatgacataatcacctcccagaggccccacctcctaataccatcacctgggggttaggtttcaacgctagaaaaagtcaaactataccagcgactagaagaatttcataaaattctggaaagtctgtcacgttctgatagtgctgcttctctcctcctgggggtcatgcgtaaaatgcctcagccattccgagagccagtgaggtgatctgcggaagagaggaagagcagagctgggcacagcatcccctccactttggaagagaaccctgatggacaagggagtggtggtgatgctctcaagaggtgttgtgagggaaagggtgagacagagtgcagacagagggtgaggcagcgccaaaggacagatttgagggttccttttaaagactagatgtgccagccaggtgcggtggctcacgcctgtaatcccagcactttgggaggctgaggcaggtggatcacctgaggtcaggagttcgagaccatcctggccaacatggtgaaaccccctgtctactaaaaatacaaaaattagccaggtgtggtggtgtgtgcctgtaatcctagctactggggaggctgaggcacgagaatcgcttgaacccaggaggcagaggttgcagtgtgttgcgatcgcaccactgcactccagcctgggtgacagagtaggactctgtctcaaaataaaaagaaacaaacaaacaaacaaaaaaacacaaaaaacaaaaaacaaacaaaacaaagaaacccaaactagatgtgtctgttaaagccacattaacaaaagcaaaacctctgcagggatttcaaatagagagaatgcaacgcggggctcttactgcacagctggcagaggaggtgaggagccagcagggcaagctgagtaacccggggctggcatgtctgacagtcacagccaccttgctggagagaggctgggcagtggtgatgtttggggccggaaagctggggctggagatggagtgtggtgggctgcctttgggagctgctgccagagacccagcagtgagcagagaggtgatgcggaccagcaccccctcctcccgctcatccctaatcttcctctggggcctaccattggccaaacctgcccaggagcctggggtgagtgggcctgaggaatagaagagccagaactgtggatggacagctctatgggagatttgacaactttaggggtaggatgaaggaggtgagaatcagagccatggggtcgggggacgggggtcagagacgtggccggggtgggtctggctggaggagcaggaagcctgttctagcagttggagcaaagctggcgtttacagggagaaggtgcttcaccctcaagggagctcagaacaggccctgggaacgctggcctggggtcctgggtacgctggcaagggtcctgcagaggtttcctcgctgccactcccacaggagggatactgatatggtttggctgtgtccctacccaaatctcatcttgaatcctagctcccacaatccccatgtgctgtgggagggacccggtgggaggtgattgaatcatgggggcagtttcccccatactgctttcatggtagtgaataagtctcatgagatctgacggttttataaggggaaacaccttttgcttggctctcattctctctcttgtctgctgccatgtaagacatgtctttcaccttccactgtgattgaggcctccccagccatgtggaactgtggtccattaaaccgcgttttctctataaattatccagtctcgcgtatgtctttatcagcagcatgaaaacagactaatacagatgctccgccacctcacctctcggaggagaaactgaagcctgagacaccaagctcacagccccaaaagtggccaaatcaggatggaatccaggtgcagatgattccaaagatcaagccccttggagccacacatcctcatacacacacaccctcccaccttctcactcaggtgcactcacagcccctggccccctggcacactcacactcacacatgttcacacccctcgaacactcagcacatctcctcagtcacactcatgccacagtcgcccacctaccccgggggtcagagttgcccttggcacagcccggctgtgggaaagggcccagtgctctagggctctcctggaggaagctttcattgaagaccagacctggggcatgcggcgatgtccccactgttcgtgaggttactgcaggggtttccgacttgcccctttgcacaaggacagggccagtgcttagcacatggtgcttagtaaacagatgatggaggaatgaatgggtgaagccaggcgtgtctgggagggagccaaagccccgaggcagaagagaaggaaggacagacgtgaacttgcagggtgggtggtatgtgcaaagaggtggtggaatgtttattatcctgagacctggggtggaaagtcctttgagacagacgctggtgtttgttcaggatcctctctaggtgggtgggtgggggcagctgtgtcccctgagggctgcacgtgggcaggcaccctgcttcagaggagggaaagctgccccacctgagagtgagggagagaaaggaggaagagcagggaagaccaggggaagtggggagagggaggggaggcaggcaaggggctgggactagacagggaagatgacttcaaggaacgagctctccaggcgcctgacagcaccaagctgtctctattcagcttctgcaccactgccatgcaagacccttccagaaaagtcttctccactcatgaatggacatcctaactgacctcagcttgggtggtgggagggggatggacgtgagagagataaaggaggagctgaatttcatgctgggaccatgatgcataaacagttgtgtttgcttcactccacaaaggcagacacattcagggagggcgttctcagtagaggaagaataatggcagctcataaaatatcatggaaactgacagtagtgtcttccaggcaaatttgataagcctgttcctaaaataaacttaattcaaaaggaacacgggcagcagaatgtgaattatcttttaactttcttattatttttctggcgcttcattctttttactcaagatgctctagtagtagctcgttttgcctttacaaggagcaagggactccagactgtcagcatctagctgaaaaactgcttctgcttgggtagtcctcagtcctcccagagcgtgcacagcacagcggggaatttcaatcgctgcaggtgcccagggcttcagccctggagattcaggatcagtttacctgggctgggagacctgtacttttaaaaagcttcaaggtccttcaaatgggcactcagaaccaagaaccatgctgtttggtgctgaagctaatgccactccacccaaagcctcaaaggttgcttagatacccacacacttctgctgaaacaagcttccagaaaggaatgcacagatgaatgtcgttaacaaggcaggccaaatgttttgagttcagaagtattttttctttcttttttttttttttttttttgagacggagtcttgctctgtcgcccaggctggagtgcaatggcacgatctcatcacactgcaacctccgcctcccaggttcaagcaattctcttgcctcagcctcctgagtagctgggattacaggcacgcgccaccatgcctggctacattttgcatttttaatagagacagggtttcaccatgttggtcaggctggtctcaaactcctgaccttgtgatccacctgcctcggcctcaaagtgctgggattacaggcgtgagccatcacacccagccagagttcagaagaattttaacccagtaactgaattttctttttacaaatgtaatgatctttaaggtagatggtgtggtagcagggggttctgggaggtttggcttaataatatggaatatcaaaatgaggggagaaactgaataagggtgtgtttatgcttacattaattatttgtaagtgtatctatatagctttaaataactcaagttgtttttcttttcttattcaaataccacgaaatccaaaagctatgaattctctgaaatatggactaatgcttagaatgttacaccttcctttccccttccaaagtgtcgttactactttgatagaagctgtaggcacaggcttcataagtataatcatatcactttcattcatagccaagaaaaaattgagcttcttattgagagtacatgtcactaagaatccagcttctgcagagggggcagggggaaggttttctgcttagtcccaaattgctttggccatgattggatttcagtgtgaaaaattgaggcagcctgttcagggtgagataggaggaagagaatgtggagccgctagttgctgagcagctgtgagacagtcagcatacaggccatgcctcattttcccatctacaaccaggggtgattgcagtatgtggcatccaaatgctgaccactctacagcttccaccctgcggtctcaacagtactggggacctgagaacaagacagaggtgagcctggtacaaagcttcagccacacacctactcatctatgctgtcatactcacttggccctagccagaaccacagatgacatcatcccgggtaaattagcattatttccaccattactcacctctgcctgccctcttgccttctcttctaggaagttacgtatctgaaagtggtaattaatgcaagtgagagatctggtcacttaaatgtgtgtggcacctctcccctctcctcttcctcctgctctagctatgtgagacgtgcctgcttcccctttgccttccgccatgattgtaagtttcctgaggcctcactagaagacactatgcttcccgtacagcctgcagaaccatgagccaattaaacttcttttctttataaattacccagtctcagatatatatatatatatatttttttttcttttttttgtgtgtgagacagagtcttgctctgtcccccaggctggagtgcagtggtgccatctcggctcactgcaagctccgtctcctgggttcacgccattctcctgtctcagcctcctgagtagctgggactacaggcgcccaccaccatgcccggctaattttttgtatttttagtagagatgaggtttcaccgtgttagccaggatcagtctcagatatttctttatagcaatgcaagaatggactaatacacatgcttactttcaaaaacttaaatatatgaaaagtataagaaaaaaattaaaaggatggatactcccaaagtaagaagatcatctttctttacatgttgatgcactttcttgtagcctttggtctaaacaggcctctcaaacatcgctgggtcctccttgtacatgggttctcaggaggtaccagcactatttgttccccaattctcctcgctcatttactctcactctcccattctccccagttgattttgggcatccacaaggggctctcacacaggggaagaagtgactttcacaccagtcatcttgtgatttctagggcacaagcaacactcctcagcaccacggccactgccatccaagaagacatcaccccccttcaccaaagagcccctatagcagccccaaaccggcaagggccaagcagaactgtgctttcttcaggccctactcaatcatggcccaagtctatagttctgcaggagagggaaaaaacatcccttgtcccaatttattttgaattttgtcatctgtctttggaaaaatagtctcataaattttaccttgcactcctccctccccagttcccccttcaaaggccttgccagttactcaggaaaggagacacatacttgagaagtggggtgttggggtagggggcagggatgccaccagctccacagtcaatctctttacttctttttaaatatattcttaattgacaaataataattatatatatttatagggtacaatgtaatgttttgattatatatacattatggaatgaattaatccagctaattaacatatcacttcacatacttattttgttgttgtgaaacatttaaaatctgttcttggctgggcacagtggctcatgcctgtaattccaacacttcaggaggccaagaagggagggtcacttaaacccaggagttcaagaccagcctgggcaacacagtgaaaccccacctctacaaaagaatacaaaaattagccgggtgtggtggtgtgcagttgtagtcccaactactcaggaggctgaggtgggaggattgcttgagcccaggaggttgaaggtgcagtgagccgagattgcaccactgcattccagcctgggtaacagagtgagaccctgtcttcaaaaaaaaaaaaaaaaaatctttgaacaactttgaaatgcacattgcattattaactatagtcaccgtgctatgcaatggatcgcaaaagcttatcccgtgctgaaactttgtgccctttgagcagcctctccatacccacccacacccagcccctggtctctacctctgtgagtttggctttttcagattccacatattaagtgagatcatgcagtatttgtctttctgtgcctggcttatatcacttaacataatgtcctcccggttcatccatgttgtcacaaatgacaacatttgtgaatagtattccatgacgtatatataccacatttagtggtacatcaacatacatttagtttgttttcatatctcagctattgtgaatgacactgcaatgaacataagagtgaagatatctcctcaacgtgttgatttcactgtctttggatacatacccagtagtgggactggacagcaaccttgatgtagtcttagaaccaggctgtgcatgtgaatgtgtgtgtgtatgtttatgtgtgtgcacgcatgtgcctgtatgtttgtacacattacataattgtaaactttccatcagcacaattttatattatttttgcttcatgtcacttaagaatatattatgaatatctttacatgttaaattttgggaaacctcttacgtttgctgcacatatatgatttgcttctccttactgggcatttgagtaccttgcatatttttccattttaaatgatcttgcagggaatgtcttttgatatcaacctttgttatttgccttggagtgaaattactgggtcagatggcatttacattttaagccctaactctgcttatagaataaaaggcatgagcacaatagagaatttccaaaagcaaagcaagtgcagttgtcctctgggggctggggacagtcactctagaaccacagcaggtgggtggctgtctgctacacttatccatctaggtgcatatatatatatatcttagacatatttttgttagaaacagccccgcagctttagcctgcagctctcccctcttccccccagacatttctcttaagagtgatgggaatacattctatgaagctgctgttaggcgagacagctcccagtaatgccagccatcaagtgattcccgtgaggggctgtatgggtgaatgctcggcattgcaacagtgcacagcaggccaccagtctattatccaccaaatctcgagattcagcccaggatgcattcagttgctaaaactgtcacggcagccactcgctgctagctcttaggcaagaaaatgtgcattccttcagaaattcagggaaagccgttgtctctataaaacagaaagtccaaagcaattgcgcagctgcatgatgttcagcacattacatggattcttctcgcatctgcctcttaagttgtgtaaaaatgattatgcaattctaaatttggaaacttaccttattgtatgcaccagggactcaacagaaatttttatatcatattcaagaatagcaagtggtaccaggacactgatttggctagcataaatgttacaattgctaaatacatggagtcagactaccaaaggattcatttgtttcaatcaataaatattcattgaacactgagtctctgtgagaccctgtgccagaaccagggaatgcagtagagaaagaccagcctggttctgccccaggcattaagcttcccaccatgtacactagggcacttcatcaacagcaggcttatggcccgccttggtcatgagcataaagaccattgctactaatctttatagtaaagccctgcagagatgggagtgagagcccgtctctttgacattccaactcacatctctacattcccctgacagtgagctttcaatttgcccttgtactgtcctgtctcatgtttccctttgatctagaatgctgatctgcacctcttctattggcatacatcatacagccaatccttccatgcctcgcctgcctataacacttttaatggggagtcttgcccaaggctccaagcagaaacagccacgctctcctttactgtgcattgtgcatgcctctgtgatggtgttactatgccgggacctctaggccataattttacatgtattaatctattaatagctccttctccagatgtaagctaattggggactgggacataaagtacttatgggttgaatgaatgaatgaataagtgaatgcaaagctgatgcacacagattttagccacaaagaaaaatttccccagccattattgatagaatatgagcttggagttgtttttccagccttaagaacagcagggctgggcgcggtgggtcacacctgtaatcctagcactttgggaggttgaggtgggagaatcacatgaggccaggagttcgagattaggctggccaccatagtgaaaccccatctctactaaaaatacaaaaattagctggatgtggtggcaggtgcctgtaatcccagctacttgggaggctgaggcaggagaattgtttgaacctgggaggtggaggttgtagtgagccgagatcgcgccattgcactccagcctgggtgacagagtgagattccacctccattaaaaaaaaaaaaaaaaaaaagaacagcaggaccgggatgtaggatggctggaggcagaggtataacctatgtccatgaagctgagaatgaccaatggcttgtaaagagcttagatccataaccctggactcactgccccttgactgttgacagataggacccagaaaagtagtgtcacaaagcacgagacagaaaatcaaccattgtcccaattctataaaaatggactcattcaatgtaaccctgggagacttggttgaacttcaccaaaaccccagttccacagcctgtggcaggtggaagcccccaccatgatgcctgggtctccatagcctcactcctctcccttctgtgctcctgccacctcgtgggctgtcactagtggatgctgagacacagaactctccccttcagtagggtccacaggaaatccattcacatcaagtattttgtgatttttgttaaactcgcactgaagattttgtttgtcaaagaaacagtcatatcactcaccacacaaatacacttgcaccagcttgcctgtgttgacgctgcttccttctattttctgactcctttccttctagtacagtcaaaatattccccacttgattctggccctatcctttagtccatacccagttcctctaagaaattaacttctacctccactcactgtatcaatgcaatccctctgaacaaatacagggccctctcaataaggacttctggagattttgacgttctctctcccacttcatcaagcagttgttaaaatttgctgtttgcctcccccaacctcccaatccacaggactcttctttagatattagcataaatcagcatgatttgggggaaacaaatcgtatttccatgtttacatggtcactgctttctgagcaaaaggtgctggcaacctgggttaaaggacgtttgagtggcaacaaaccttggaagttaaagtagtaacttctggagagattggcagcagcatctcccctagcgatgggtatttatattccaatggttgatggacctagagaccttctcgttctctccccagagagcctttgtttacatttcagagcaaaagctctttctctttctctacctggggtgagaagaggaggagcagctatgtcagcagcttttatgtaagctccagaatttatactcctctccggtggcccaaattcctacatctggatctcggtttgtcactctgagggggatggatgcatggggactggtgcaatgatggctatgtgagcaattaaaaatctatctctgatctagaaacctggcatttcccaacagaacaaacaagcaaataagtaaagttatacaagtaaaagttataaaatggatctctcaacatgaactttgttatttcttcgataaatagattggaacgaagtagaggactgtgtaaagaaaaaagcagggaagaaattattaacatctctgtgaatatatttcatggtgacgtgtcatgtatttcatgaaacctaagatagcaaaagttataagatgcactattatttcgtgcaccactacaaaagaaagaaaaagcctgccaattaaactataatgcaatgatttctagtaccttagaacttttattttattgaaagaattattttagattaaaatatagacaaatctgtcatataagtgacataatttagtcaaggtattcctaaagcttttttacatttaaagtctgaaacttgtggatttcttttcaaatttcaggtgaacatcagtgtcattgatgttcatgttgatgacacagcatttttttaatgctggaaatgattacaattgcacctcacaaattagtcctcaatgtcaataatatcctaattgttgttgggccaacagagactgtaggaagctgtcaactgtagtatgcatcccaatttcgaagatatcggaaggtgaaaaaatgtgtcttttgaataattaaaaatatggtatatgagatagactttttgactttaaaaagaaggaaggggagaagacacaaaagtagcagttgactgaagttattttaataaaaatgtaagaaaaacatgtctattaatcaccattaatgatcacaataaacaatttttaaggtgacttgagtcaatttctgaatttccctttccttcaaaattcccagtaaatgattaacaatgaaaagacttaggcatatgaaaaatacatgggctgaaaaacaggaacagtacatatctgcgaacctagagggatgtcagatgatccttgagttatgagggggttcatcctgataaacccatcgtaagctgaaaatatcctaagtcaaaaacacacttaatgcacctaatctaacaacgaacactatcacttcacctagcctcccttaaacgtgctcaggacgcttaccttagccgactgacagtagggcaaaatcatctcacacaaagcccattttacaataaagtattgaatattttatgtaatttcttgaatactgtactgaaagtgaaaagtagaatacttgtatgggcttctaccaaatgtgtaacactgttgtaccatggtaaagttgaaaaatcattcagccaaaccctcattaagttggggactatctgtatggatagaagtgggttggaggtatcccagccactctgattccacacatgtgagagtgcagcactcctggacagtattggacagaatatactcaaatctgcaaagacacagcggcaggagctgagcacgagggcaagacagtgtctgatcaacagggatgacctactgaccacagcaagggctccagggtcacaccaagcagactggtgttggctcccaggatccctgagacagaaatggtgatgctccagtgaatggagcctgcaccccacacagggaaaagaaagttctctggggagcccagttctccctttgtggcctaggacctgacacactgactctgtctgatgcactcaccagtggatctccagagctcactcagaaactggcacacagccggtacttgggggttggctggattcatttattttacacatatttgagagcccagaaaggaacaaacagtggttgaatcaccgggcatatgggaataaaccaatgtcagagtctccaaggaagtttacattctaatagaggccataaagagatcaatatatcccaggtcaggaggagatgagcccagaaaggacaggaaagcaggtaagggaggcagggcttgggggataggggagcgtggctgcagatgaagtaaaatggttgggaatgaggctcacagaagttgctggggcagcagagaaatgaatgaaacaatggaatgagtcccatggacacctgtgggaacagcattgcagaaagagggaagagcaagccaaggctctgaaaaaaataagcaaatggatgcaacagtgaatttacgggactaacctccctatccatccaaacccaagcttcctgacttctatttcacctgagactaaagatttgcccacgtcatctctgaaagaaatgtcctcaagttcacattctgagcaaacatcacccttcctggctaagaatgatgggcaggtgggggcgggtggagggtgaggttgaagtacaaaaaatgtataaaaaggtgaaggatgtataaaagatgaaggagttcaagagaagggcacgattacggtgaactagaaccaatgtcccctaagaagtggacttgctccaaggagaaggaaagaattatttccaaagcgtttttttcatacacagttttactttcaacatgatgagagagacaaggcagttctagagagagaacatcatcctgaggtcagcgaaaattgctttcagtagaaaagctattaccaaattttaaaacacaataaaagagtttaataaggtgcctagttacaaaataaatctataaaaatcaatagctttgttttacagcaataataacctgacacaaaatgtaatgggaggaaaattccatgcaccatcatgatgataaatatgaaatacacaggacaatcttcatgaggtatgtcaacgtcctagatgaacacttcaaactttacttagagagagaagacatcatgttcattaaagggaacaattgatgttgtggttttcattttctctgtcgtaattttcattacctttgtattaatttgctctgatgtctgtattccccactatgctgtaaacttaataatggcaaagactcggttccattctttgctgggtacatatccaagtacatagccaagtcttgggacgcaggaggtgctcaataaacattacttggattaatgagtgaagacggagatgatcacaaaactaaattgtcttaaaatgacctccagaaaaatccaagattctgccctgaatcaaaagaatggtttcaaatcatggtaattcttagacaatcaggaatttaattctgccaacataatatttctggagcctcagcaaagagtgtacatcccaacacatttaggcatagtaaaagtgaaaaagatgcttccaagaaaattaccatcttggtaattttcccagcagtcctggggggtcagtgaggctccttgaaatgttccagagacttccgggagagcggtaattcctccagaacttccaacatttattacattgacaatatcatggaaggaaacgcttgtttggaaccaaacctaacttgatagctgaagccctttggccttcttagacgtggaaatcagacagcataatccacatagaggtgaaactcagtttccattccaccccttcttcttgacactgggaaggaaaggagaaggagctactcttgaaatggataccccatggtttagtagaagacactgatgacttttcagtctgcaagaagagctctagaacccagtattgggggcaaaaaaagagagaccacataatccttctgcatatggaaaggatttgctttgaggaaggagatgccacgagcagaacgggaagtcagagagcaaacaaaatggcagcaggaccctggagcccgtgctggtgagaattgtcaagggattgtcggaacaagtcccagtgctcagttaagtccaggtctgtaaacagatagttatacgaatcgaggaaaaggagccaagttccacatgtagattggtacaaagactaggaattggctgtgggagggaagagctcagcgaggctttgagttctgccagaagtcaaactcagcttgcaacaatcacagggagattggtgggaggtagggagggctgagggggcaggtggattacttggtgaaacttgcaaggaagggccaagaaggcttgtctgagccaaggccatcctggcagcaagtccctgttagccacatggaaggggacagccttgctattccttgcaggacaaatcacccttggagagctacagcccgagacatttacaacctagagcttctctgtaagttaccaggagataagtgagagtatacatacagcagatgaaggctgatggaaagaatttggggtgtttgggctaaaaagagaagtccatggggaaacaaaaaggtcatcttcaaaacatggatggactgtacttattattgttatgattctggagggcaaattggggttaaaagatggaagcgtgaggccaggcacagtgggtcacatctgtaatcctagcactgtgggaggccaaggcaggcagatcaacttaaagtttgagaccagcctagccaacatgatgaaaccctggctctactaaaactacaaaaattaaaattagcagtggcaggcacgtgtaatcccagctacttgagaggctgaggcaggataatcacttgaacctgggaggcagaggttgcagtaagccaagtttgcaccactgcattccagcctggggggcagagaaagactccatctcaaaaaaacaaaacaaaacaaaacgtggaaatagcaggaagaaataacttgcctcaatgcaaggattaatatttctggcaattggagaaggctaagtatgagggtgcccttccctgcacatcagttcctctctcacggggtaaggtgggtccacagggcagaggaggaaagagcccgggtccagggtttgaggagggatttggggaatcgctggggcaagaggaggtgcttccatgggatcccttgatagaagtcccagcatgaacaccagccccagatgcctccgtgggaagtggagcttctcacaggcaggacacagctcctcacagcagcagcgatcaagcgctttggggagcatttctagggtaagaacagacactcttgagcaaactcagggacagtcagacaagtgcccctactgactgtcaggtgggctcttcccaagggaagaggtggccagagcatctgcttcccggagtcatgtcacagaacggaggaaacatggggtactcccctatgcagaacggttctccgagctctcagcccagtctacggggcatttgtgctgagagctcgtaggattggctgggagggagtggaagcaaaaagcctgagcgcaccactagagagatgggaagggacgtatcctgactggcttgggaaaggtcttctcccttcctgtgcagcaagggcccagggaagtggcatctaaatcagtgactgtgttgacggccattacaatgagaagattggcctcggccgccgtgctcagaggctcaaggcagcctccattgctcacagtggccccccaggtgctggctgactaccccggtgccactgtagtcagcacaggatcaggagcaggaagcccggggtctcccatttcagagagcagttttcatggtcacaggcagcaccagagtgacccagcctgggcctaaataagaaatcgactctggagggagcaagggctcccagatatctctgaggacaccctctggacgctgttgctttggccttttggtgttgctaatgcccttggctttttcccatcccctgaagcgtgtagattaatacaaattccctgcatttcccataacccctccccaaaagcttggatacataacttttgagcctcgtaaagtgctccaagcattgtgcttcagggtgaaaccagctctccaacgttccaaggcaagaagcactggccagctaaataggatttggaagttccgaagagcaggctgggtaacacatttagagcagtcttagagcagtgccatagacaattttctggatccttggatacaatagcacagggaaaatgtggtttatgtggccaagcattgcttagatgggtataaaaagaatattggcttaaaattggctgttttacaccaataacaacctgacacaaaatgtaatgggaggaaaattccatacaccatcacgatgataaatatgaaatacacaggacaatcttcacgaggtatgttcacatgaagaggaatcttcacatgaatcttcacatgaaaaggaattctatagcaaaaatatctcatcaacatgaggctgacttgaggctgttttaacatgattgagttaaaagagtccaaaagaaaagaaatgaacaatgtaatttgctcttattgctcctactattatacttaaagtgacatgtttatttctattttaataaaagatagaagctaaaattctcttaagtgtgaaacagctgggtttagagagggtttgatcaattaagcaagtaaatgcctcacaaaaacaccctaccatttggctgaaagatagtttctgctcgggagagggctgaggctgcaacaatgaaaaatagcattttgctgaaaacagaacacgtcagtagagagcagattgaatcccataatcaattttgtcatttgaaagtaggctagatttctctcttagcacaggcattaattggatataagacagcaatcacaactgtgttttcaatctataggaaaaattatcttcgtttccccaaggcctgcagctttcataagaaggcaggagtttttggaggagagcgtcgtgttcgtctgtctgtagaccctgagacactgatttacagcaagactcacggtgacaag

SEQ ID NO: 244 - DNA, 79069 bp, Homo sapiens
agtgcaataccataaaccttgaataacaccatgggacccatatgaagggccactaggaatgctggaagtgctcccaagaagcagagatcagtcatgactttacaagaagaagttgaattgctcggtatgtaccatagactgaggtctgcagctgcagctgcctgctgtttcagacagctgatttaccttgtaaacagacaaaggaagcttatggtatcaatacacacagtacggcactgtaaatgtattttctcttccatacaattttcttaataatgccttttcttttctccagcttaccttattggaagaatccagtacataatacatgtaaaatacaaaatatgtgttaatcaactgtttatgctcttggtaaggcttccagtcaacagttagactattagtagttaagctttgtgggagtcaaaagttatacatggatttttcaactggggagagggtcggcgtccctaaccccaggttgttcagtagtgaactgtagatgcaaaatgggtggctaataattgcattccaccagatacaacaaatttgcatctatctgggcaaaactaatttgtatccgttttctaattaaagagttgtaaaatagctcagagattgttaatggccatccccagaaagaacacacagtaatcctttgttttctattttgacgaatttcaaaggcttacagctttttctaacagtagtaggaactgttagccatgatttaagaagtgagaatctgaagtaagagttttttaaacaaaagtctccttgtggttatattctcttgctgtatgtacttattcacatgtctagaaatctgatttcaaaagccatccagtttggagagaaatccagtgtttaatgttacatctttatcccagtttttacaatagtggtttttacaatcacgttggttcaaattaaatgattttatagcctgggtggaatgcctttctattaatcgtaattttctttttctttttctttttttttttgagatggagtctctctctgtcacccaggctggagtgcagtggtgtgatcttggctcactgcaacctctgcctctttggttcatgcaattctcctgccttagcctcctgagtagctgggattacaggcgtgcaccaccacgtctggctaatttttgtatttttagtagagatagtgtttcaccatgttagtcaggctggtctcgaactcctgacctcgtgatctgcccacctcggcctcccagagtgctaggattacagaggtaagtcactgcacctggccttaatggtaattctctatgtcagttctcacctcaaatgtagcccagccttaaaggccctcttcttcctttaggtggggccacaaggacatttatttctccccttccttcttggacaaatgcttaaaccagcccaaccccgaaaggcttggcaaggtttcccctctgcaaccagcccaactctgactaggtggttcattagaaataaatctcctcttgtttctgagcctttgagcaggtacaggtaattctgcctagaccttggcctttgtccttgtttccatccctgcaatgggtccagtggccctgtctcactggggcttggtgtctccatcccagggacccaaatctaacaaatctctgtgctgtcctccctccacccagaccagtgttaacttcctgcctgatgtctgaccatttccgtcccacatcagtgccccctgcaccatctggccttggaattcctgagccatgtctgggtgtttttgtgcatcccttgaacatgggggctcccactggactcagcatctctgtaagttcccccagcatctgccttgccccagtgcagagtctagtgccaaagccaagtcctctctccagccaaaccggcccttcctgccagaagcctgaggctgggagtgagtcatgggataatgtggaagatcagttagcattttaagagctcacaaatgtattctgcttcagacagcatcataaaaaccaagtggttggctaggcacagtggctcacgcctgtaatcccagcacttagggaggctgaggcaggtggatcacttgtcaggagttcaagaccagcctggccaatgtgatgaaaccccatctctactaaaaatacacaaattagctgggggtggtggcacgcacctgtaatcccagctactagggaggccgacatcgtgccactgcactccagcctgggcgacagagcgagacttggtaataaaaaacaaacaaacaaatgaaaaaccccaaatagtctaggtgaacacaataattaacactaaacagacacttggcaagcaccgactatgtcccagcatgcttaggtttattatctttaacccttagaacatggaagtgttaggtatggtgtgaatttagactaactgtgtaagtacagccatgcatgagcaccagcagggtgacccaaggtgaagcagcatctcctggttgttttcaaataaaattttaataaaatttataaatttaaagttattggtttatccaggtgtattagtggtctggctatgtatactgtgtcaactttttcatgaaaatgctttggtcattctagttcagtggcagaaagcacagtgcaaaacggcaacaatgatattagcgacaaaaccttgggatgggtcgttagagaagatcaagaaacagatgaaagttggctttcctaaggccttagtgtctgcatgtcttagaacggccaaaggacgctgacactctatctgtgaagctcacaggaggcagaggacaatgaccttggcaggagttaggtgtcccctgaggtattttagaatcaagtctctccaggggctgctattccagactcaagaaggatacaaatttgcactcttcctggtgcttttagatagtgcttatttagcaaaatcagatacattttcagatgcagaaattatgctttggagaaactcttcaaggcagctggtggttaacaccttgggtgagctcatccaggaagtagatggttattcatgggtgggagacccaggagagtagcagagtgcaagaatccactggattgatggagaatagtctctttattaaaaaaaaaatggagcattgcaattatttcagtttagttaaatctagaataaaattagtgccacttactttagcatagtattctaatgagaacgtggctatggaaaggatggattagagaagtgttataacttgtatctgggcttctatcatttaatacataaacctacaatatggtggcaagcctaccgcagccttgggtggcttccaaggcttggctcttgtcatatttactcccaataatgacttatgaagtctattgttaaatagaaagatgtttcgcacagttaatggcaaataaaaacaagttaattttagcctcactggccattggtcctgaacttctagttaaatgcttactgctagtttgttaatcatggtaacagaaaatttttagctatgtattttatgaaagaagaaatgatgttttagacatccagtttaatacatctaagcaaaagctggtgattttaatttttgtgctagtagaagaaatggttacttaaaacagcttcaaatccctgattattgaatgatcatggaatctgcatttggcaaagccatcattttacagagtcagctctttcagaggtcactggcaaatgagaaaaaagactgtcgggtttcagacaagtgcccctgaaggtgccctgcacagaggttggcacaaaatgggcccacagagcaacaggggtaatagttatcctctgtcctcctctcacgtaacaaaatgccctcgtccaaagcaaagcacagcctctcttttcctgcatctcctgactcccaaggtgaatctgcaagtccatcacctcctggatctctctgtgacagcgacggtgatgaccccacatggcttcctgaaagtggatcttcggggccttggctctcctcccaatccccctccctcatggactcccattcctgtttctcctaaacttgcaaacactaggcctgccacctgccaggaaatccatccaggccctttccctggaagccaagtgctactaataagtttgaatgacttttttggggccatctatcgtttttcttttgtcagttgcttggtgtcattatctttcaattttcctttagggataattctaaaaaccttatttttttttgtttttgttttgttttgttttgttttcacacagtagtggcactatggtttgaatctttggtttgtcatgtctgttgcagatgtatttttgcttttaaattttattcatggaatttttgttttgttttgtttgctttataaataagtgatttttgaatgttgtcaaagccaatgctcacttggggattgggtgtgcctggccctggtacagtgggatctgtatcctaaacaacaactgttgtgactgaaactatttggcttcctggaaaaaaaatcctcacctcttgctcgacatcctcaaaacaaaaggtgatcatgtcccaacactagggcagtgtatatgctgtgctgcggccgaggctaaaggggtacgtggctctggggtggagaaccgggagacagaggtgcttcgatgagaagaaagacattgattacctggtcaatccctgtctcatggcaggtacgcgttcaatcagttcttgcatgctcaagcacaatctcttggttgggttgcatgtctgttttcttgcttctttgcctggattcaaattcttgaatccggagatctttttagataggaatatttataaggattaaaataatttctgtacaaacaatattttatatatacacacatacattattctctctataagatttataccatggccaggtgcggtgtcaagcctgtaatcccagaactttgggaggccaaggctggtggatcacctgaggtcaggagtttgagaccagcctggcaaacatggcgaaaccccttctccactaaaaatacaaaaattagcccggcatggtggcacacgcttgtaatcccagctactgggcaggccaaggtggaagaattgcttgaacctggtaggtggaggttgcagtgagccaaggtcacacaactgcactgcagcctgggtgacaagagctaaattacatctaaaaaaaaaaaaaagattaataccatttctatatatatagtattttgtacacatatatatctaaacacaacaggtgtgaagcatgagattccctttcttcatattggcaacaaggactgtgattgctaggattggaaatagtatcatttttattatttagtaagatttaattaacaaaaataaatttaaaattttatctttgcacaaaaaattttgattgaaaattctgatagccactaattaaaactttgccttttaattgtaataagttatcacagatattttagaagaaaaatatttttcaaaaactaattaaaataattttagattttttttttttttgacagagtcttgctctgttgcccaggctggagtgcggtggcatgatcttggctcactgcaagctctgcctcccgggttcacgccattctcttacaataattttagattttaatattcattcaatgtatatttttgaagaagaaaattcaaattttgtacacttaaaatgccattaagttttgctttataatcctttggattgttagagtcaatggaatatataaattatgttaaaaaatttaaaataatgtagtgatttttactgaagtgaaggcaagaaaataatttttttttttttttgaaacagagtcttgctctgtcatccaggctggagtgcaatgtcgccagctcggctcactgcaacctccacctcccaggttcaaacgattctcctgcctcagcctcccgagtagccgggactacaggtaagcgccactacacccagctaattttttgtatttttagtagaggcgggatttcaccatgttaaccaggatggtctccatctcctgacctcgtgatccatccacctcagcctcccaaagtgctgggattacaggcatgagccaccgcacccaacccgaaagtaatttgtatgaatgaaatataacattttatttgttatttatgcttgttttacgacttgcccacatattgatggctcagcaacagaatacccaaacacaacacaatcattatgacatgcagtctttgatattttgctaacttccaatcttaaaaagcatagctttctatgaatttcatgtttttgttttatgacagtatagagaaggataaaacatctttaatttaacaatctgttagcttgatttataatttcagatccttacacacgtgttatatgagctaccgtttccaccctaggttgctggccttgtccctgtctggctgccctggtcaaaactctcctgttgacatgcgtgtcttttgtgttgtacttagaagtccctatttggccttgatttaatacaaatctttctgttgttttctttcctattattttcatgactttgttttatatattaaaatcattaatccatctggaacccattttcattcaagataaaaaaaaaaaacaaacttaactctgtgtctgaaactcagccaattatgcaaacatgatttgctggaaaatctctcattttctaactagtttgtaattttgcctttataacacgttacatttatttatcacattgtgtgtctgtgtggttttaattttgtttgtttcagggccaattgtactgtttttattgctgttgttttttcagtcgttgttttgttttgctttatgataacccttagggtatgtcttacctcattatctttatttttaaaaaattgatcaggtattcttgagaatatactgtccagatatactttagaatgtttggcaaggtaaataaaattttcttctttgttaaacgagcagaaaatgtttatgaaactttggagaaaaaagagaatgccatgcaacaactcacctgcctagtgtaccatcattttcaaaaaatgtcttcttttgggctttggagattatgaaaatacttttttttgcatattcatgagttctgttctgctttgctttctaaggagaacctgctcaggcaagctgggaatctacgtccaggatctggacctgccaacgaggctgagggactctaatcaggcagtgaggctggccttagcaatgcagctgggcttcgaaggcccgaggttcagtggggagaaatccaggcaagaagggtgctgggaagtgtgccaggcccagctgagcaaggagagattctttgaggaaaccactaatgggaatgcgatgatgccgtgtttccgaggatggctgctgctagggagggaagcaggctcgtacctggagggtcaaggtgggtctcagtcctgggagggagatcgggtgggaaggaagccagagtgaactgtagactggtgattgaggccaagatggggtctatggatggagctggggggaaaacactgcagaactggggtacacagggagctcggggctgctgcaggtgctgggatcccaagtttggggcttaccaaggcctgtagacctttctttcttcttcctttcccttccttcctttgtttatttttctttctttctctctcgcttcctccctccattcctcccttcttcctttctcttttccctttccctccctcccttccttccttccctttcccttccttccttcctcctccctccttctctcccttctttctcttcttttctcttcctcccttccttccttccttccgtccttccttccttccttccctccctccctccctcccttccccccttcctttctctctctcttcctcttccttcctttcttcctttcttttttcttttgagagggtctcactctgtcacccaggctggagtgcaatggtgtaatcatagcccactgtagcctcaacctcctggtctcaagtgatcctcccacctcagcctccctggtagctagtacaacaggcatgctctgccacacctggctaatttttgattttttgtagagatggggtctcactatgttgcccagctggccttgaactcctgacctcaagtgattctcctgcctcagcctcccaaagtgctgagattacaggtgtgagccactatgtccagcccctattggctctctctgagtccccagtgagagctgaaatgtcatccaacaaccatcaacctatcacagaattattttctttttccaaccttctcttttaggtattggagattataaaagtacatttttgcaaattgatgcattccagccctactggaaacatactacttttgaggtaggctggctagaaaggctttcaagagcctggctgcagagcctctcctcagcttctgtccatggagaccggcgggagttcagggacatcctgcctgagccttgcacaatggtcctttcttggtggacctgctcatgtacagcacaaagtttgtgtgacttctcagcatctggtggttaaagacatgagaggagggatttttcaaaatgctgaacagaagcagttacccaatttgcagggcctagtgcagaagctgttaaggagtttgagacggtgagggcagaacattaaacctgacccaagctgtctgagcccatgctcatgaggcagctgtgacccaatggtgtatgatgtacaaaatagatgttccaatagtcaaacgtttaacccatacctgaagaatcataatggtcttcggagaaactgtttggattgggagtctcaagataaacacgtggggaatttttagagatcagcattgagggagacaggagattcgctgcaggaaattggaggtggagagaaaggaaaaagagaccgaataccctgggtgcttgtggggtgcacactgcgagagcctcatttatttttatttttattttttgagacagagtcttactttgtcgcccaggctggagtgcagtggcacgatcttggctcactgcaacctttgcctctcgggttcaagcaattctcctgcctccgcctcctgagtagctgggattacagacgtgcaccaccacgcccagctaatttttgtatttttagtagagatggggtttcaccatgttggccaagctggtcttgaactcctgacctcatgatccgcccgcctcagcttcccaaagtgctgggattataggcgtgagccaccgtgcccggcccacttcttccctgtaacccaagccccagcaaggagagaggcgatgatattgacaaacactagtagcaccaacctggtaaactattgagaggaccagaggcaaaatatgctacatggtacaaagaataaaataaaatcaagggagcaagagaaataaagtttgaaaataatgaaagaaaagattcaaatattcacagagataaagcagactttttttttttttttttttgagacggagtctcactctgtcgcccaggctggagtgcagtggcgcaatctcggctcactgcaagctccgcttcccgggttcacgccattctcctgcctcagcctcccgagtagctgggactacaggcacccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcccggccaaagcagactttaaaaaacagaaatgaagtaggaatgacaagactgaaatataaggagaaaaagaaagtaaaaagtgaaagaacaacataaatgatttttaaatgattgtgtcagttttccagggcacccttgataaagtaccacaagctgggggcttcaacacagaaacttattctctaacagttctggaagctggaagtccgagatcaatgtgtcagggggctcgtttcttcccagggttctgagggctccctcccagcttctggtggattgcctgcaatgttcagggttctctgacttgtagaagcatcaccccaacctcagccttcatgttcacatggcattctacctgtgtgtctccgtgtcagaatgttcccttttacaaggacatcagtcatattgaatcgggtgcccaccctactccaggaggacttcatgttaacgaattgtgttggcaacgaccctgttttcaaaccaggccacattctgagatattgaggataaggactttaatagacaaatttggctgggagggcacaattcaatctatagcaatgataaacaagagaaagataaaaccaggacagtaaagagataatttagaagaaaacactgagagctatattccataaatatcactacgccataacaggcaattatgaaattttaaaaattaggtactcgggaggctgaggcaggaaaatggcgtgagcctgggaggcggagcttgcagtgagccgagattgcgccactgcactcctgcctgggcgacagagtgagactccctctcaaaaaaaaaaaaaaaaagtaggatactaaacaaatcttttacgtgaacaaaataacaagaaccaaaaccttatggaaaatataaccagagcaatacaaacaaatgattaagacagtgagtgtctttgacacggtgtggcagcttctttgggctgagaccccagggagttttatcctcagggcagaaaatcaagagggggtgggtcaacctagacacctggggcctcctccctcctccctctccaggtcagaggctgacttctcaagactgaccggcacacacctgacagtccaccatcacctgccaggcatggggccctctccttgtttctttttagattgtgtgccagggacaaaataatataatcaagccccatgatggcataccgtccacaatctgtcccccatcattctgcctgggaaattcttgccaactctgctggttctctccttccaacttggctagtgtgtgtgtgtgtgtgtgtgtgtgtgtgtgtgtgtgtgtgtgtgtgtgtgtgttcctgtgtgcatgcgtgcctggtgcatatatgtgttttcacaaactggcacatatacaaagtagtcaagatgtaccctgaaagagaatgcctgcttggctctgcaggagaggatttaccagttctgctagacttgcaggaaggagaagagaaggccaggagttcttctggggaatttctttccttccttccttccttccttccttccttccttccttccttccttccttccttccttccttccgtctttctttctttttccttccttccttccttccttccttcttttctttctttctctttcttttctttctttctttctttctttctttctttctttctttctttctttctctctctctctttctctctctttctttctttctttctttctttctttctttctttctttcttttgctttccttctttccttctttctttcttttttttttggagatgtagtcttcctctgtcacccaggctagagtgcaatggcaccatcttggctcactgcaacctctgcctcccgggttcaagtgattctcctgcctcagcctcccgagtagctgggcctacaggtgcccaccaccgtgcctggttaatttttgtatttttagttgagacagggtttcaccatgttggccaggatggtctcaaactcctgagctcaggtgatccgcccagctcagcctccctaaatgctgggattacaggtgtgagccactgcccctggcctgatgaggtttctttttaaggggcttatatggtggggggagaatggtgttgtgagaagcagtggttggttttagggagatactaagaaagagaaggggaaaaaggttattaaagcttgcttctctgtgcttgtctattttctctgtggcattttttgagacactgaagaaaagatctgaattcctttcaccttttagtttccttgggagtgactcaagcactgggaccaagtgaggtgcttaaaaaaaaataccgattgcaattttctcagtattattgattaatgtaagtagtgaacacccaccagccgcaggggctgggtgaggcagtgaatgtgcggggagaggctgagtccacattccagctgctgctcttccggcctctgaaccatttcctacaacacttttgacaccaaatgttgaggggcgtttttccacaccaaccacttctccaacactggccggtgcccttcaattcagttcaattcgcttcaattctaacacgcagctcgcacaagttaacacaccctcttcacctcagacgccaatcagtcacaaatctcagcctcttgcacttctggcccgtcagctctaagtcagggattcccaagaccccctccttagtttgataatttgttagaagggcttatagaactctggaaagtgctttccttaccattactggttcattatagaggatacagctcataaatggtcaacggaagagctgcccagggcgagggtgggcaggggcgtggagcttctatgtcccagccctgaagcaattcgacaacccagaagccctcagaaccccagggtttagggtttctatggaggttccattatgtactcatgactgattaaatcattggccactggcgattagctcaatccccagcctctcttccctccctggagggtggggagtgggaccccaggttcctagcttctcattgcatgggtggttcctccggtcttgaagctatttagggggcatcagtgtcatttcattagcgtaaacccaggtaaggttgaaagagctgattttttttttttcctttgagatggggtcttgctctgtcacccaggctggagtgcaatggcgcgatcccagctcactgaaacctctgcgtcctgggttcaagcgatcttcttgtctcagcctccttagtagctgggattacaggctcccaccacaatgcctggctaatttttgtatttttagtagagatggagtttcgccatgctggccaggctggtctcgaattcctgacctcaagtgatccacctgccttggcctcccaaagtgctgggattacaggcatgagccaccgcacccagcggaaagggctgattctgatagcgaaagatactcctctaacccccatcacttgggaaattcccgacggttttaggagctccataccagaaactggggacaaagaccaaatatatgtttcttagtatatcacaatatcacatacctaagtgacttctttccagaaagttccaaaccttctcacttctttttctcatttgtgctatggggacaattaataataatataaagttattaatataatattaatattataattatattattattttaataataccccttattaaaaataatctttttttttttgagacagagtcttgctctgtcaccaggctggagtgcagtggtgagatctcggctgactgcaacctctacctcccagtttcaagcagttctcctgcctcagcctcccgagtagctgggactacaggtgcccgccaccacacccagcttatttttgtatttctagttgacagtgggtttcaccatgttggccaggatggtctccatctcttgaccttgtgatccacccgccttggcctccaaagtgttgggattacaggtgtaagccactgcgcctggccaataattactttctaatggacttctcaccaacacatcacaggttctcaactgaaacatcggtcgttcctacctggagcagttaaaatgatgtcaaacataccgattatttatagcagccccagtctattcctgacctcacctggtgtgaatgacagctcttccctgcacagtgggggccgtctccttgtgaccactgtgatacgttccacctgagtggcttcaactagggaaactctaaacatttagtcttggttaattattcttcatctcaccatctcaaactttcaaatattagagatgctgtaccaaaggtggctcaaggacaagtgtggtgcaggacagagggtgggacctcatgttacaaaggccctgtgggtggctggagacccagtgtactggtgcaacagtacttgcagagaagtacattggcttgtggttgagactgaaggaactcttgttaatggcagagaagacattggcttgtggttgagactgaaggaactcttgttaatggcagagaagacattggcttgtggttgagactgaaggaactcttgttaatggcagacatgggaaggcaattagagggagctgtggttttgagagaagggagagggagaacagagtgggaacagggtgagaaatgatggatttctgacatttctgggccatggaaccttgtgaatccatagcccttctagacctctttgatctctctggtcccttctcctccacaccatctccaatttcaggctctcactgggtcctttcagaaggagaagtaaggaacactccaggggcagagggagccagcacagaaggagtaagaaattcattatcaaacaaaaggactagaatacatttgaatgaataaagaggaaagctgtccctttttgtcctgctagaatatttgaaatgcaaaatagctggtgtttatacaaatttacagcatctattgtacgtcttagtcacctataccatttggaaagctgtgtgttctctaactagaggcaggtccggaagtaatttatgatgaacctgtgtgcacttctccctccattcccacaccccctgctcaaattggggagagagtgactacacctgcttttgaatccttctctcacccggcccatctgcccgctggaaaccactcttgggcttgaccacacttttacaggctggccagggaaagtcctcggggataacaggccgcaaagacccctaggtgatgtcagttgggggtgggctgggtgtggatctgtgaaagttgtcagaatcaatatagagtcacttatgtcaaatcctaataaaatgaagtcaggaggccgtgaagggaaagccctcatgtatatttgccttatgagaagaactaccacaagagactctcccaagccacaaccctgaagttaagcccacttctatgaggacagctttccaataacagccagttctaactgcaaccttgcaagtagccttacgaaactgcaagcttgcagtcagtgccgctcctgtgaagaccctctcctagtactggccagtgcacactttgccacctgtgataagccctgtaaccaataaacttttgtttcaaaacctgcacatacttctcctttttgcctttaaaggtttgcctttgcctcagcctctccagatatgcctatgagtagtcatagcatgcacatctggattataacccttctgtctgatcctgaacaaactcatttctttggagggccactctgttattttagattgacatatctgttaagcaatcaggattttccttctaactcatattttttatccttaaaagtaaatttatttctgttatgatggtgccaacattttttatggcttcttgtggcagccactgaaagaaaatttattttgagtgtacttgtcctctttgggaaatatataaaagtaagataatttttcccccagtgaatttatctaattttctccaatacccaaatgtttccaactcatagatgatttccaaagatacctggtgatgtccatcttattgcacactggagacaggaagaagatattcagaaaataattatatttgaaataacgtttcctcagtcaataactgtctagtcattgtcatctcttttccatatcacctctggccccttcggctcccctctccttctctatctcattgctggggctggctgcagagcctgtcaatgcccatgctgtgtggatgcccaaagaatgcccacatggggctgcccccaagagtcaagtccacaaatggcgtttggagtcacagggataagaaatggtttgaaaactttggcctaagaacggttaagtgatatggcatttccctaagaacacttttagttataaaagaattagaaatgtttctaggtaaacgattagttgaaatcaccttgaaaagaagcaatcaggtgtgaaagtcaaagtcacgggctctggagatagacaggacttggtcaaagcctggcattcccattgcccagctgagtgacccttagcaggtcacactcctgcaccaaacctgttttgcatcttcagaaacaaaggtaacgactatcaacctattgcatattggctgatgtgaggatgaaatgagaatacatcgggcttctgtgcctgatacacaggaagcactccacagaagtgaggtgcaattgctgtttcttggctttaaggaaatacaagcgtgttctttattcccctggtgagacacgtgtcacggagattctcctcccatccattcgtggtctggtggaggtggacaacagaaaggccaatatcatacatacaccctgcaagagcctccccagccaccacctcctgatcagatggaacctgtgggcaattggctcctcagcccctcataggccaggcctggatgtccaaggctgagcaagcaaagctgtcttcaggctaatgtgtctaccaccataaagatgctctcacgggttaaagtgttgtgaacccccgtccaggtgatcctggcctggacaggggataggcaattcctggctctcttcaggttgccattatgcatacaaatacatgcatatttagttcaaaattaaatgcattcttagctaatatacatatgttatcttagttcaggctgttacaacaattaggctgggcaatttataaataatagaaattaatttctcacagttctggaggctgggaagtccaaagatcaaggcactggcagattccacccttccaggtggcaggccgggcatctcacctggactttcaggcccactcctttggcttccagatgcatcttcttgtctctggtgaccatgtcttcaagatgtcccatggagaggtccttctagcacccacctagtcatgtccccctgccatcccactttctacaaccttgctggctccccattaagcttagggtgagacatacctgacattcatgactcaactctgccatttctttccaccttcactgctggcctctcccaccatgggccaccttgtgctgccacagaatgccgtgaccacatgttaaccctggggggcctcaggcctctgtgcctctctcccagggctgctctgcctgggttgtactgtccttcccttgctgaggcagctggagtcagatgtctttctctgtgaaaccttcctcagcctgccctactcaccttcttgtatctatacggctctgttcaagttgccattatgcataaaaatacatgcatatttagttcaaaactaaatgccttcctcgctaaaatacccatgttgactcaggtcaggctgttacaacaattaggttgggcaacttataagaaatagaaatttatttctcacagttctggaatctgggaaatccaagatcagggcactggcaggttccacgtctggtgagggctgctctctacgtcaaagatggcgcctcattgctgcatcctcacatggtgtaaagtggaaaggcaaaaaggatgaagagatgaactcactccttgagcccttttagaaggccctaatctcatccaggaaggcagtgcctaattggtatggtttggctgtgtccccacccaaatctcatcttgaattgtagctcccataatcctcatgtgttgtgggagaaacccagtatgaggtcattgaatcatggggacaggtctttccagtgctgttcttgtgatagtgaataagtctcgtgagatttgatggttttataaagggcagttccctgcaccagctctcttgcctgctgccacgtaagatgtgtctttgctcctccttcaccttctgccatgattgcaaggcctccccagccatgtggaactgtgagtccattaaatctctttcctttataaattacctagtctcaggtatgtctttatagcagcatgagaatggactaatacactaatcatcttccaatggtcccacttcttaataccatcatcctgcgctttaagatccaacatacgaattttggagggacacatacatctgaatcatggcacacatccatacaaaatgtgtatttacgtacatatgtaagcaaatatatacacatatgcatgcatgtatatatgtctacatttatatacatgtactgtgagctccaggcaggtgaaaatgttgttttgttcaccttatttagtctggtaggatttatctatatggaatatataaacaaatattaattacatatttttcaaataaaaatgtatgaaaatataagcatattaagataaacatgtaattttgcctaacgatataaacatggaagtaggatatacaaacatagatatattggtaaataagtatattgacataaaaatacatatatgtaagtatattttttccacatagaaaactgaacttgtcccaaatcagaaagggaaaggtttgaaatgctagctctctctatatagtatatataatccagattttcatatatacatctatctacctctgaaatctctatttagttctattaatacatgtcctttcttgttccaattttacagtattttaattattactttatactgtgttttgatacttgataaggtaatttccttctcattatttttgtttttaaaattttattgctatttttgcatattttcttttctgtatgaacttgagaatcaactaatcagttacaataaattatttttcacttatttttattattttaaattatttttatttatttttaaatttttatttatttatttattttttttcagttcttttttttttaattttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcaatagtttactgagaatgatgttttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaaccagtttacagtcccaccaacagtgtaaaagtgttcctatttctccacatcctcttcagcacctgttgtttcctgactttttaatgattgccattctaactggtgtgaggtggtatctcattgtggttttgatttgcatttctctgatggccagtgatgatgagcattttttcatgtgttttttggctgcatatatgtcttcttttgagaagtgtctgttcatgtccttcgcccactttttgatggggttgtttgtttttttcttgtaaatttgtttgagttcattgtagattctggatattagccttttgtcagatgagtaggttgcgaaaattttctcccattttgtaggttgactgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaagtgtaaggaagggatccagtttcagctctctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagtttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaagttggattcctaggtattttattctctttggagcaattgtgaatgggagttcactcatgatttggctctctgtttgtctgttgctggtgtataagaatgcttgtgatttttgtacattgattttgtatcctgagactttgctgaagttgcttatcagcttaagaagattttgggctgagacaatggggttttctagatatacaatcatgtcatctgcaaacaggtacaatttgacttcctcttttcctaattgaataccctttatttccttttcctgcctgattgccctgcccagaacttccaacactatgttgaaaaggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgtagggttgttgaattttgtcaaaggctttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctgatttagtcttgggagagtgtatgtgtcaaggaatttatccatttcttctagattttctagtttatttgcatagaggtgtttgtagtattctctgatggtagtttgtatttctgtgggatcagtggtgatatcccctttatcattttttattgcgtctattagattcttctctctttttttctttattagtcttgctagcagtctatcaattttgttgatcctttcaaaaaaccagctcctggattcattaattttttgaagggttttttgtgtctctatttccttcagttctgccctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacgtttgctgaggagagctttacttcccagtatgtggtcagttttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagactcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgacactttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtcttgatgatctttacattttggcatggttttgcagtgggtggtaccggttgttcctttccatgtttagcgcttccttcaggagctcttttagggcaggcctggtggtgacaaaatctctcagcatttgcttgtctgtaaaggattttatttctccttcgcttatgaagcttagtttggctggatatgaaattctgggttgaaaattcttttctttaagaatgttgaatattggcccccactctcttctggcttgtagggtttctgccgagagatccactgttagtctgatgggctttcctttgagggtaacccgacctttctctctggctgcccttaacattttttccttcatttcaactttggtgaatctgacaattatgtgtcttggagttgctcttctcgaggagtatcttcgtggcgttctctgtatttcctgaatctgaacgttggcctgccttgctagattggggaagttctcctggataatatcctgcagagtgttttccaacttggttccattctccccatcactttcaggtacaccaatcagatgtagatttggtcttttcacatagtcccatatttcttggaggctttgctcatttctttttattcttttttctctaaacttcccttctcgcttcatttcattcatttcatcttccatcgctgataccctttcttccagttgatcgcatcggatcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcatctgaagccttcttctctcagctcgtcaaagtcattctccatccagctttgttccgttgctggtgaggaattgtgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctatttgagtaccctgccgtgtgaggtgtcagtatgcccctgctggggggtgcctcccagttaggctgctcaggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagactccatgggcgtaggaccctcggagccaggtgcgggatgtaatctcgtggtgcgccgttttttaagcccgtcggaaaagcgcaatattcgggtgggagtgacccgattttccaggtgcgtccgtcacccctttctttgactcggaaagggaactccctgaccccttgcgtttccggagtgaggcaatgcctcgccctgcttcggctcgcgcacggtgcgcgcacccactggcctgcgcccactgtctggcactccctagtgagatgaacccggtacctcagatggaaatgcagaaatcaccgtcttctgcgtcgctcacgctgggagctgtagaccggagctgttcctattcggccatcttggctcttccccccttaaatttttatttatgtatttatttactttttcatagaaccaccaagtccaatacaatacattttggcaggagttttcattgagattacattgaatttatagattaaggtaaaatcaatatttttctggttaaaaaaactcctatcccgaaataccctgtttttctctttaggtttttagcttttggttaggcgttacagaagatttctttatatatgcatagcgcattacttggtagatatattttaatgtgttttataattcttgttactgtgaatgggatagttttttgaaaataaaacttcttatagtggaaagtttcaaaagcaaaggcaacttgtgtgaggggaatgaggaatccttgtgttccccaaaccaagctgagtcatgcccactcttcctttctccctacgccacatactcctttctacctccccagttattttgaagcaaatcctggatttaacattatccaccattggctctttcatgttaattttgggcctgaaaacttacttagctttcttattcgttttaataacatattgttaatttactttgctttttcaggtagagacacttttgacttgatctctgcagtcctcaacatggtatgtaacacaagataggtccttaatacttgcatttgcttggttcgaaactaaacgcgtgaccgtcacgatgacatctctcagcttgctctcatgtggcaccactgggtcatccttcccatcccatgacagttgttagactcaagttcaggtttagttggtctatcctagccccccgtgttgtttaccattccacagacaatgcatttcttggctactgggaaaaaacatcctgcagtgtgaaccaatctccccctctccctgcctagccctgggtctcagtttgcagaggctctgccttgggctcattctcacagagcagcagcagccgcagataaaagtggggcaaggttcacctgagcacaaagcagagcccggactggctaataaattatgtagagattctattgctcagaacctgaatccattattcagctttaaaacaggaataaaatatgcaaatgcagcaggcagaagtgcacacacagcacacaccatgcttcagccttggcaatggctgggcccactggagtttcagagacagacactttatttcctctgcctacgagtgtgtagaaagagacagaaatctcagccatggcaaaaaagcaccgggccactgtttatcttcagatctggccttgggagacatctttagtggcccccagcagcagagaagtcaagaccagcctctggggagaggcttgggtcaacctgtccttgtctttcccctgaaagagggaaactctttgatggcagtttcaatgcaaagttgtgcccttcccgatcccattctcctataaaataacctattattggtggcatccatatatgaacataaatcccctttgacaatttttgtttgatattttgggttagcacattctgctacttattgggtaaggtagtcatgttttctttactctgatgttgacctctttctatcaagtaagttgctgagacgaggctgggcgcggtgggtcacacctgtaatcccagcacttttggaggccaaagtgggccgatcacttgaggtcaggagttcgagaccagcctggccaacatggtgaaactccgtctctactaaaaatacaaaaattagccaggtgtggtggcgggtgcctatacttccaactactcgggaggctgaggcaggagaatcacttgaatctggtaggcagaggttgcaatgagccaagatctcaccactgcactccagcctgggcaaacgagtgagacaccatctaaaaaaaaaaaaaagaggtctacattcagcttgtctactcctcagtcacgattttaaggttctcatccataagagaggcctgaggcttctcagttttaaaaacgtgtcctcatggcaactcccacaccatccttgactctgatcccccctgcttcttctctggctttggtatggctttctttggttctgccacccaaagtgaaactggcttggttgtgtgcctaggctgggaagatttaatctcattgaaaaagtagctgctatttaatgaaaagagggctggatttgaaatctgaaaatatgggctcaaggcctgcaagtacaatttactgctggggccaccctggtggagccgtttcgcatcctggagccgtcagtgtcatggataacactgaactcagtgaactcagacctttggtacaagagtcagacaggatgatgggtgtaaaagtattgggtaggatgtgttgtttatcctcatatcactaggactgtatccggctgacatgcaccagaacacattactggttgttaaaatgctgaagtatttctgtgccaggtcagaaatagctgtctttccaagaagccccacacccccaatgtcccagggttcctcagtgctcttcccacctcgacctctcgtttactgcccctgcattcccactgtcctgcaacgaaagagttaatggctggtactattcccgagactcacaattttctgcctttggctccaggcaacacacatttattttcagcattaactggagcttaaccccaatgttaaaaattagaatctgcagaagttaaaattggccgcttaaggcaaattctctctccctctctctgaaagtatgaattactgcttctactgtctgggtaagatgaacttgatataatagccccaatcttgtttgttccaatagaatatttcatacggtcgaagaaggctaaattatgtgttttgaaattccctgaagctgcaattcaagaagtgtataattaagccctggcattattaaggagtagaaaatatttttcttccaactttcctatggtttaaaaactattcaggctttggatttttgtgatagcagactaggtgacacattctaagaactaccgttaaatggtgaacgaaagtcaatgaatgtggccctcctgctgggagtaaaaagactttctcacagctttgcattggcagcaggcgtaggtattcccttcttggaggcggccctgagaatctgtgacaggtgcgacacttttcagctacagtgtctggaaaagatatggttcagccttcagatcccttcctggcaggggtgacgagagtgggccgtggcagtcattaagttcattgtttcagtgagatccatacctccttgagaactgcttatgtttctctaaagagataacgtcactaaagggtgaaggcttttaaggataaaatcacacaaaaaagaatatattcttgcattgcttagatgttgttttccgtccctggggctgttataacaaattgccaaaaacacgatggcttaaagacaacagagttttattctttcacaattctgtaggtcgaagtctgaaatcaagtgtgagcagggccacatgggcccattctgaagacccgaaggagagtccccctttccctcttccagcgtctggcagtcctaggccttctttggttgacggcagcctcacttccatctgtgcctgtgactcacatagccctcttctcaaagtctctgactttctcttctcttaaaagaacacctcggctgggtgtggtggcacacgcctgtaatcccagcactttgggagccccaggcaggtggatcacctgaggtcaggagtttgagaccagcctgactaacatggtgaaacctcgtttctactaaatacaaaaaaattagctgggcatggtggcacatgcctgtaatccaagctacctgggaggctaagacaggagaattgcttgtgcctgggaaggcagaggttgcagtgagccgagactgtgccattgcactccagcctgggcaacaagagtgaaactccatctcgaaaaaaaaaaaaaagtaaaaagaatccccaaaaaacccccacacctgctgttgagtttagggcctctcctcaatgcagagtgctctcatcttgagataacttaatgatatctgctgataaagatcctttttcccataaggtcacattcaccaatactgaagattaggacatgaatgtatattttggagtcacaatttaacagactttagatgtatatttaaaaaattcggaagataactaagggattgattacaatagttatctatctggggagagggcggaaagagaggataaggcagcagaggaggaagggagaattttgcttctatttcattcttaaacaatttaaagttttgagtctggtaaatctgtcacttagtaaataattaaacaagtaaatctaatttaaaatgatacattttcatttttatacttttttttttttttttttgggacagagtcttgctctgttgcccaggctggggtgcagtggcacaatctcggttcactgcaaactcagccttcccagttcaagcgattctcctgcctcagcctcccaagtagctgggattacaggtgtgcaccaccacacccggctaatttctgtatttttagtagagatggtgtttcactatgttagccaggctggtctcaaactcctgacctcaggtgatctgcccgccttggtctcccaaagtgctgggattacaggggtgagccaccatgcctggcagtcagtttcaatctttttcaatcttttttttttttttgagatgaaattttgctctcattgtccaggctggaatgcaatggtgtgatctcggctcactgcaacctctacctcctgggttcaagcaattcttctgcctcagcctcctgagtagctgggattacaggcgcccaccaccaggcccggctaatttttttgtatttttagtagagacggggtttcaccatgttggccaggctggtcttgaactcctgacctcaggtgatctgcctgcctcggcctcccaaagtgctaggattataggcatgagccacagcatggggcccagtttcaatcttttaccaatgaaaacctgaacacaaaacaataattcttaaccaatcatgatgaaacacagtaacttttttttttaataaaaggaagaagaaagtgttgaaaattgacatctatgtttacatatcacagcaacacaaagtgccagcaaaaaaaaaaaaagtggaaaaatgaaagtatcttggccccatgagttttgctctgcttcccactgtcatttattcagtacatgtgtcactagatccaggacttgctctagaagttggaggaagtcaatggcactgtgagaaacgtgaattaccaagggactctgtcatgtccttcgttactcatgtgacttccttacatgaaaggaaaatagatcctggggcctccaaatcactcagctaaagggaaaagtcaagctggatctgcttagggcaaacctgcctcccatttattcaaagtcatcccactcttcactgagataaatgcatatctgatggcctcctttggaaaggctcatcagaaactcagaagaatgcaaccatttgtctcttatctacctatgacctggaatttcagtattaaaccaatgtttatcttgcatatattgattgatgtctcatatctctgtagagactacatgaaaattttgttgttgaaataattcgttgtactgagcttcaattgaaatgcttaaataccttgaaaacatttccatttttgcctttactcaaatcaggtggtggctactttctaatgaatgcaaatcccagtatgtgaaaagtgtgggttaggacaataaaaggggaggtgacaccattttaatggtttctcagaagctgtgctccgatgtccttgggcacatgtcatcagtacctcctgaggttatgtcacaggtgcatgtccttaactttggcaaaataaacttcctaaattaactgagatctgtctcagatattcaggcttcagagctatgccagctaaccccttatgctgaaaacgaggacttagaaggaaagggcaagagagccagacttgctttttccttttttttttttttttttaagtctttccttattcatcaataagccaaaagtagaggttgttagtagaaaatgtgtgcaccaagaagtgaaataaagacagttgagttcatgtgttgtagtgtttccaatgttctgctaagaatgaaatatatatgcatgtacaagccacaaaatacaaattgtgtaattttggtgatgctgcatatgagttaaatgtacttatgtttgtatttaaacgtgaaattgcacaatatgaagagtaatggtaaaattcatgctaatgatttaaaattgtattctttctttactcaaaacgacctcaaggagcaaagtaaaaacaccataacaaattgagagactgtagaaaaagggaaaagccttatcttttactacattccatggcacgtttctcctgctttttgaatgagagcacttacagtttcattttgcatttggctgcaaaaacagcgcagcgccccctgcagggagctgtatcacggtgttctgatcagcctctggggaagtggcctcctctggtccaatcagcttgtggactgaggatcacgtgatacaaaatatggccacccctgcatgaacctggagcaactgccctgggtaggtacccgtacaaggaaaggcaatccttcaagcaataatcttttggcagtctccctcacctctgttcacccctgggtatttttggcattgctgtttttaatgatggggtgtgatgtttcctcagcctgttaaacttcattgtgttattttttaactgcttctgagaaactactaaaatgctgttacctccctttttattggcctaagccacacttttcacatactgggcttttcattcattagaaagtaaccacttattttgagtaaaggcaaaaatggaaatggtttcaaggtatttaagcatttcaagtgaagctcagcacagtgaattatttcaacaacaaaatttccatgcagtctcttagaagaaaaatgtatcttaactaaattttaggacttcacattttgttttgttttgtcttggcttatttgttatttaaatgtgcggatctgtgaaataacatcatttctttttaaaagacagcaggttctaactttagtacttcctgagcaaaaagaactaaggttgcagaaagcttctctttcaggctgtctttctggcattgctgcaggcagtgctgcccttgctgggaggtctccaccatccacattagcctgcatgtctctgtccctttgcttcgtttcccacctctacccacctgcccaccacactctcacacttcccctgcccaaccagaattgccatcaggggctattggtccaatcccaaatgctagtaacagaactgaaaagcccaagtttgaagggaatttcttcttccgtgaagtcccctgggagaaaattttctggaagactcaccatcccagaggctacacagctcaggacaacccctgttcttttaagggaaaagtgaaagcctggacttgtaggttttccccaccagttttcacatggagctgatatcggcatctctgcaaggccaggaggagattgagtgacctctctggaactccgaagtttactttccctgcgttttcgtaacttgttctcagctctttgaactgcatccaagtgcctagttcatgatgccataattgctcaccgggttcaagggcagagctctggtttcatattgtaaaattcagtgcacctgggtaccacataatagctgtgctaagacatgtgtgcattacatcagctatgattcattcctgtgatctagtttagaccacaatctgataacacaaaccaattacttaaactgttagaagatgcttaactggaaaaaacatatctttagttttccttccaactttagtctaaaccatatatatatatgtttttatatatatatatatgttcatattccatatatatgtattccaaatactctacatgagttttaacaacaaaacttgggggaatgggatctaaaatgtatttcccaggtctagcttggatggacttcagggtcattaacaagctgtgccaagcagcatatgaaatcggtgagataagctttgatgcatattagctgtgggaccttaagcaaatgactcatactctctgagctaaagttttcttatctgtgaaataagcatagcaagccctccccctaaggactgttggggttaaattaaatggtaaaagctccttagtcagtactcaatataggttcagtacaaattggtcttttttcctttccaatcatggatacgtacctgttgggcaaagtaggtttctcctggccatgccaggggacttctcactgtgctgcagccaaggcttgattgagattggctcctctgggtctttagggacatatcttgattgatatcaaccaatcacagttatcctgtgttagggcaacaaactgctacccaaatctgcagcctggtggcagggattgagttaggggtgacccaggcagtgcaaagctcagccatttttttttctccatttggacgtgagcaaagaagctgtggctctggttactgaaaagggtgaaacaaagaatctccaacagacaggcgggggctctgtttgagcaaagtctcaacgggactcttgttttatagcactatctgccatcctcaaatacaccagctaccactctgggcacccataagaacagaatgtcactcatctctgggttttcgatccagagctgcaagtggatgagaatggagctgaatcacataggacccattcgagcacttccaccagttgagcctcttcgaatggattttaagatcacctccttcacactagctgcatatgtggagcttccactgttagacacaacacaatggaatatggctgatatggtttagctctgtgtccccactgaaatctcacctcgaattgtaaccctcgagtattgagggagggacctgtaatccccaggagtggagagagggaagtgattggattataggggtggttcccccatgctgttctcctgatagtgagtgaattctcatgagatctgatgtttttataaatgatagtttttcctgctctctttccctgtctctctctccacccttctcctgtctcctctcttctctgccctcctctcgctctctctctcacctcctgccatgtaagatgtgcctgcttccccttctgccacgattgtaagtttcctgaggcctcttcagtggaactggctgaagaggctgaggcaattaaacctcttctctttataagttacccagtcttggcagttttttttgttttgttttgttttgttttttgagacagagtctcgccttgtcgcccaggctggagtgcaatgccgcaatctcggctcaccgcaacctccgcctcctgggttcaaacgattctcctgcctcagcttcctgagtagctgagattataggtgcctgccaccatggccagctaatttttgtatttttagtaaaggcggggtttcaccgtgttggccaggctggtctctaactcctgatctcatgatctgccctggcagttctttatagcagtgttataacagagtaatgcaatggctatctctatttttacctgctggtaggaaccacaggcagaatgttaaacctctgagatctctccagaccataagagtgggtataacactttcaggattgtgccgtttaacccagtaatctaacttttagacacatctcctgagatacagtcctgagaaagaaaaaggctgtctttgtgaaaatgttattatagcattacctctgtatatattttgattaaaattagaaaagcattacacttagttgtaaaaactgacagtagcaaaggattgaaagtgaaatatattagctcattccttccacatgacccctccatggcctcacatcccagaggtagtattattctaaaaaaatttatttacataaatgaatatattggagacatttgtgtaaaagccttaatttgtgtttaaaaatatttaagggaggccgggtacaatggctcatgcctgtaatcacagcactttgggaggccaaggtgggcaaattgtttgaggtcaggagtttgagacagccttgccaacatggtgaaatcccgtctctactaaaaatatgaaaattagttgggtgtggtggcaagtgcctgtaatctcagctacttgggaggctgaggcacgagaatcacttgaacccaagagacggaggttgcagtgagccgagattgcgtcactgcactcaaacctgggcggcagagtgaggctccacctcaggaaaaaaaaaaattataagggaatatcgaaataatgagggatccactaaattatactgtaagcaaaacaaaataaaaccaacaaaccaactagccctaaagcaacctaagtgccatcagtctggaacagattgatgaatttggtatcatctaatggaatgctatatatccatgacaaggaatgaagaagacctacatgtattttaacagaaatgtgtctaagatacaccctatatgccagtaagtgaaaaaaaacaagttacaaaataatatgtacagtaccattcctttgcagtataatgatatggtttgtactattctatagttatcataaatcaagacattttttgataaatggagatattttggatattatatactagtattaattgctgatgtcagaagaagcatggaaaaaggttctctggactaagcaatgttctgtgttgccacagctgctggctcagtgatatggctgggctctgtgtccccacccaaatctcatcttgaattgtaatccccacgtgttggaggaggggcttggtgggaggtaactgggttatggaagtggatttcccccttgctgttcttgtgatagtgagtgagttctcatgagatctgatggtttaaaactgtttggcacttccccctgcatgttgtctctctcctgccaccatgtaagacagggcttgctttgtctttgccttctgccataatcataagtttcctccctcacagccatatggaactgtgagtcaactaatcctcttttctttataaattatccagtctcaggtagttctttatagcagtgtgagaatgaactcatacaatcaggttccctccttagtctcagcagcatgctgcatacctgatctggctatcgaaatctctataaatgtctttaaattttattgagtctaaaagatgctggaagggatccagataatatgtgtcagaatccatcttgattcctgataataaacaatcagtgactactgtttacaagaagtaataaagagagagctaattaatagcttggcaaagcaatattatagagaaaatcactagtcaattttattagtctgttttcatgctgctgataaagacacacccaagactgggtaatttataaagaaaaagaagtttaatggactcgccattccacatggctaggaggcctcacaatcatggcggaaggtgaaggaggagcaaaggcatgtcttacatggcagcaggcaagagagagaatgagaaccaagtgagaggggaaccctttaaaaaaccatcagatcttgtggaacttattcactaacatgagaacagtatgggggaaactgcccccatgattcaagtatctcccaccaggtcccttccacaacatgtgggaattatgggagctacaattcaagatgagatttgggtggggacacagacaaaccatgtcattaatgaaataagggacttcaaaacaaaccagagcaaatgtcttccgatgtagtacagttatgtaagaaaaaggagatgttacaaattttctatcatgcgttccttaaaacatgcagaaagatattgcacctgtgaaaggcaaatgggcagagaaagaacagcgagatcaggcaataatgtgagaagatgaaaaaagcacaatagtggaatttaaaatcccagatggaagcagcaacaacagattcgaggctgcagaaaacctgatcagtgaagtagatgacacatgtgacaaactcttctgcctaaaaataaaagtcaagggtatgaaaaagatgaggaagtgaaaatgatgggaggaaaaaagacccatagtttaaggatgtggcatgtacatgtaagaaagtacagaacacatggaaaagaaacactgaacaaatagaaacgctcttgacctaaagaaagagttggccttcatgttaaaaaggttcattaaaacaaagtccaattatttagaagagcgggacaccgagacttagctttgtgacacttggatgtttcaggcacaaagaagggacccagagtaaataggagcagtaagtaaataagagcaacaaccgcaataaaaacaaaaagtcaggtaaccccaaacaaccagtcaggcctggcttcagacttccacagaataaaaatccagcaggcagtagagtcgtgtcctcagaattctgagaggagagattttttgaaaatgctgaacagaactgactacataattcgcagagcctaggcaggcagaggcttggtggacaaatcacctgaggtcaggagttaaagaccagcctggccaacatggtgaaaccctgtctctactaaaaatacaaaaattaggcaaggcgcatggctcacgcctgtaatcccagcactttgggaggcctaggcaggtggatcacgacgtcaggagatcgagaccatcctggctaacgtggtgaaaccccgtttctactaaaaatacaaaaaaattagccaggcgcggtggcaggcacctgtagtcccagctactcgggaggctgaggcaggagaatgggcgtgaacccaggaggcagagcttgcagtgagccgagattgtaccactgcactccagcctgggcgacagagcgagactccatctcaaaaaaaaaaaaaaaaaaaatacaaaaattagccaggtggtgtggtggtacactcctgtagtcccagctactcgagaggctgaggcaggagaatcgcttgaacccaggagatggaggttgcagtgagctgagatcacactactgcacttcagcctgggcaaaagagtgagacttggtcaagaaagaaagaaagagagaaggaaggaaggaaagaaagaaagagagagagagggaaagaaaggaaagaaagaaaagaaagaagaaagaaagagaaagaaagaaaagaaagaaaggaagaaagaaagagaaagagaaagagaaaccacctagagaatttaaaagtcaaaatacctggacaagaaaggtaagagagcagctgaatattagaaatgtagaggaaaaaagctctttatttcttcatgtgtgcaaattccaaagcacctcttaccaatacaaatattagtcaaaaaaaaaagataaacatcagaagagaggactatgtagcaaactggagaaaacagtatttcagtgccagacagcagagaaagggagggcaataattttcctttaaagcaattcagagaagttctcttattttctcaacatcccggaagcatgcttgcctgtatgttgtaagcaatggcagatattgacgagccgaattttctcatcctgtccagaaattgtctgaggaagtgctccaaggcatctccccctgtcaaacattctgggacacacaggtattgcaggggcagcatctgcacttttgcttggagggacgctcagacctcatgattcagcagatgcagtgcttaattgggaagccaccgtcttgtcggagagcagtgaaagaagcccatttgccccacctagctagcaactgtgttccatcatggggcaagctcaacagtcatgcccagcctgcagcgagtatgtgatggctgagaagggtgttttcagaacccaccccagcactgctcacaagccctctttgtgcatctccttccccaattccagaggtgcagcctgcacccgaaaagctgttttgctcaatgttatctgtacattcattgtgttttccaacctctcgcctccgtacttttatttccacatctgtaatccacttcatcctctcaatttaatgcaccaattatttttcactttttttgttaatttttagggatggggtctcactctgtcacccaggctgtagtgcagtggtgtgatcatagcttgctgcagcctcaaactcttgggctcaagtgatctttctaccttgtagctggaacaagaggtgcacatcaacacatccagctgatttttaaattttatgtagagacgagatctggctatgttgctccggctggtcttgaattcctgacttgaagcagtcctcccactatggcctcccaaagtgctgggattacaggcatgagtcactgcattaggccggatgcaccaaaattctccccaagcttgaaacagcggctgtgctttgtcactacgctgggtggggccagccctggaaacatccccttccccgccagcctgcctctttaatggccagtcatggaaaaaagtcagtgctgggacatcttttccaaaggaaaaagcctcaactttcagtttcaggctcttatttgtttttggttacaggaaatttctacttcttttctaatttcccatctgtttgtcaactggtgtatttttttctagctcagtgccttcccacacgggtcctgaggactctggtcaggccctaccttcttagagccacacagcgcagcaggccaggcacagcaccggagggcttggtcctgctcaggttccgagataatactgaccatgctgggggacagggctgggaaaagaaaatcccagccctgaccccttgcccacccttccttcttagcccagcagctgggtacctgcttgatatggtttagctgtgtccccgcccaaacgtcatcttgaattcctacatgttatgggagggacccagtgggaggtaattgaatcatgggggcgggtctttcccatgctgttcttgtgatagtgaataagtctcatgagatctcacagttttaaaaatgggagtttccctgcacgagttctctcttcgcctgctgccatccatgtaagatgtgaccgactcctccttgccttccgacatgattgtgaggcctcctcagcaatgtggaactgtaagtccattaaacatcattgttttgtaaactgcccggtctcaggtatgtctttatcagcagcctaaaaacagacgaatacactgcaattaccacagggctcgtccaggccacctctcccctgagcttgtactctgacttgctgaacaccattgttctgcccctgaatcttgacctctgctctgaccccaaaccctcttctgtggactcccccagaaagaccttccactatcttctgtccttggatccactgtgaccttaacacaccccaggacaccgctcaagccagcttctgagggttcaagtcccttactccagtttggactggacatggctctgtttattttcctgccttgctgtattctgaagtcccagtgccttccagccacacctcctcaggtgttcgctgtgtcctaccagtgacactgaggcccaaccagatgccctttgagaaccaaggttgggtcattctgaagacagtccattgccagttctttcatggatgtttctctttctctctgacttgcttcattctccaatttctaggccacctgctagaattttcagcaggaagttaggctactgctcaaggtgacaggtcctgagggacttttctttatctctcacatgggacaccccttgcagggagccaaaagtgggttcaaaccttgcctctgctagcaggaatgaccttgggcaaggtacagaacctctttgagcctcagttacctcctctgtaataggaaaattgtaacttccgggttactgtgagaattaaatggggttaaacatgtaagaacacacgagagactcagtaaatgttgcttctctttccttccctgccgtgccccaggagactgcatctggctattcagatagggacccagagatatcagcctcaattttttaaacacagtgtgagtgactttgatgtgaaggtgttttatatttgtcaagtattgttatttataaggcaggaataattaccttagtgagtttgggaaatattattatttttgccttttctgagacataccattcatgctgctctgggtagtttaaagtaaaaagttacatagttgataatttttttgtaatcagattcaagaagcaagcaagcttctctctcgccttttatgccattttaaatgagatgtaagtttatctagacaattgattgtgaaatattttgaagttcaaaaagatacagaaattggttacatttaatggaggacacatggatggtcatgacggggtagggaccacagggaaaacagtgtttttaaaatatcttggagatgaaatctgtggccatctaaacgtgaaacaaggagggcaagtgaagatgaatttgtgtctctgggctctcatcagaatcaatctagactctagccgacagttcttcacatcctacaattagaaaacaacttgcaaactgcacaaatcatattcttggagtgaaatcaggcccttggatactcacaacatttatggagatgctactgcccttggactaaaagcttcaaagtggtttgaacaccaattagtcttccctgccccacagctctgaaggtttgctctggttatattctataagttaaaaaaataatttttttaaagaagcctaggtaaagcttgcaaaggcaaagttactgacataaaatggggcaaataaatccctgcagagttgaaacagcctgaaaagggcagcagcgttcactgaggctctaatccctaattcattgcaattcaaagatagaggtgaatgtcacacggcattatgcacagacacattttgggatagagaaaacagagtgttgtctgcatggtcaaaggtcagcaagaaaatcattagaactgcaaacagtcttttgttgttctgggcgcattctctgaaaggtgatgaaatgtagagcgggagtcaatatgaaaggactgtgcctgagtctgctcttgagatgatagtcctgagaaggtggaaacgccatctttgtacatgaaaactggaggacactgagaccttcaggcgaatgatttagcctaagctttttgttgttgttgttgttttttctttttgagacagagtctcgctctgtcacccagtctggacagctcgctgcaacctccacctcccggattcaagtgattctcctgcctcagcctcccaaatagctgggattacaggtgcatgccaacacgcctggctaatttttgtatttttagtagagatggggtttcaccatgttggtcaggctggtcttgaactcctgacctcaggtgatccacccgcctcagcctcccaaagtgctgggattatagacgtgagccaccgtgcccggccctagcctaagctttttagtgaaccataagaggaattgcacgaagtcttgatattgttaaggtttagaatctctgaatgggggtcattaaagctgtgggaagtgctggtcaggatctgtggggtactcaaacccagagcagcaaagtccctaaaccagcctcctcgcataaagatttattcatcagagatcatgaaaagtgtaaagtgagatcagaatttcatagaatcctgaatgatttcttgaaattgttgttttgacttcacttctgtaaaatgtccactttttctcctctctaccagatcttctccacccaagtggatgttagaaggacaagtcgtatgtttactaggatacagaatagataaagttggtttgaactgatcagcaatacatcagtaggatgtggacagggagacctttcttttctggtacctgagaaatagtaaaatagtaagaggtcaccaaaaagaagtttcaacgcttctaatttcaccagttaggccaggagcgcaggcagatattgagcagctatgcaaaggcttaaattaagagaacatgagtgctgtatatctggcatatctaaatagcccaaggatggaggcaagccacagggaccaactgcaatgtgatctggggtctgggctacatggaaggtgtatgaccacaggcttctgtttacagagtgtggtgagaaagtttccattaggtggacgtgtctctccgtggaataaagcccaaggcgcagctggcctctcaactcaggtgtgtgttttaacctttcccaatagctcaggtgatcccctgagacacacaaacacacaatgtgctgcaggtgattttaagggactaataatagtagtggtagtatcatttccactttacaaatggtacaaaaggattttggctatgtctgcatgcaaagaatgaacgacaaaacctgtgaaataaatgaagaccattactctagtatatataatgcaagatggactgactttttctttgcatttgattgacttggctttggaggtgaaagtctaagaatgaagggaggagtaactgctgctactgctttaatacctttgagaagagctgttatgtcttgaatggggagatactaaaacttagtctattctcctaaaaatcctctaacacaaaaacaaattttttttaaaaaagagaaagtgaattccagattaagaaaagaatcaagtgcaatacacttaaagaaactacagtgagagtgacttttgaaatgcttcatcacatttctcaaggcaattgataatcattagtttttacaaaagggaggtgttttggtggatagatggcttaaatagtttgcagggcttgtggaccaattaaggtctgttgaatacggctttagaaaagagagctcaacctgtgtcccctgaaagtaatttgtatcatagttggaaagatacaatgcattacaaccaagcaagtcttataaacatcctgaggtttatattgattatgaatattgccacaggtgggacaggtgcaatgcccagtttgtcttggcagacttggcttatgcctgttatcctagcatgattaagagtgtcccgtttcactctaaaaggtgtcctaaatggatgatgaatgatttggtctttttattaatgaagtaagagggaaggattattcctaactgggtagactgtagatttgtgtaactaaaagggaatgagttggtgatggacttattttctaaatatattcttgctgataatttcttaagggaccaatacagaatagtaaatttcaaggactgtcacttttactgaatttttgacccaattatgatgcaattatattttttgtgtcatgttcttcatgctctaaacatagcacaattagaaaggatttgagaaaaggcatattttagatggcatcaaggtctttttttggcaacctttttcttttctttctttcttttttctttttttttttttttatggagtctcgctctatcaccaggttggagtgcagtggcatgatcttggctcactgcaacctcagcctcccaggttcaagcaattctcctgcctcagccttctgagtagctgggactacaggcacgcacacaccaccacgcccagctaatttttgtatttttagtagagacgaggtttcaccatgttggccaggatggtctcgatctctcgacctcgtgatctgcccgccttggcctcccaaagtgctgggattacaggggtgagccactgcgcccagcctggtaagctttttctactaaacaaaccatagaattctcctggtccctaaaatgtttgaataatgaacacaaagtaacatagtttatttagttacagactttgcttcaagaaagacagacacacacacacacacagagttttgtatgaggaaaatcaagaaaaacaataagaagtccaagtgccctgtgacatgttggagggccacacatggacctctccccattggacagtcccagctgagtgccgtcttccacccattctcgaaaaagcaccaaataccagtgaccctcattatttgcagattctgtatttgcaaatttatctgctcattaaaatttattcaaaacccccaaatcaatacttgcagcactgttgtagttattcatggatgtgtatggggcagcaaaaggtttgagtctctcaatgtgcatgttcccagctgaggtcacacaagaagatactttgccttcttgttatagctctcaatactgcaatcaacggtccttttcaccgtctacctagcgccatgtgttttgtgctttttgctgttgatttcactgtttaaagtgacccccaaacatagggcttaagtgcagaccagtgttcctaagtgcaaaaaggctttgatgtgccttgcagaggaaatatgtgtgtccagtatgctttgttcaggcaggagttttaatgctgttggctctgagttcaaggttagaatcaacaacatggtacattgggaaaagagaagaggaaatttgccaatctgtaagggaggccatcctagaaagtgcttaaactaaatctttggtgtgtgatggagctatgaaaaagatggggaaatggctaaatctgtagatttttgagattatgacatatagaaaaaagagtagtgacagcatttttttgtgaggctgagagccaaagaaattcatggacacattacccaggttcaggaaaatgataaactcttccatgctagtgtttccttataaagaaaatacttcatataactaattattttttaagaaatagatattcaataaggtatctttaaacaaaaacacacaaaaaccaaagttgcatattgatcagtcaacagaaatgtcgtgagctgaagctcacgggaatcgaatcttgaatttcctcagaagcagtggctccatttgagttaattcagtgcttgtggcagccactgcaagcaagaactgcctggacaacacatgagtgatgctgtctcgcaccctccagaccagtccacctccagctgagttccactgagcaatatctatgggcacatgaggcacagaggagtcccctgaccgagccctgcctaaattcctgacttacagaatctgtgagatatgataaaatggttgctgttgaatccattaagctttggatcacctgagatgcagccataggtaatcagaatgtggtaccagaagtggtagctttgaacagatattctctcttttgttttgaggcataatactgcaaagtattgaactgcaaagccatagatattctcttttgttttgagccataatactgcaaagttactttgaacactttaagaaggaggaaacagattcagagagttcagaattggtggggtatcaattcaaacgccagcactgaggaattgacgaactcagccaggcttcagccttcctcactgtaccacagttcccactggcatcattaaagacagctgtttcatgggataatgaataggcctcttttgaccttcagtgtcagtcaagctgtgtggctgtgattgtgaagaatacaacagagttcatccatttccagagatcctttaatggagatttccagcagcacctgtagtcacatggtgatatgggatggttgtgtcctcacccaaatctcatcttgaattctagttcctgtaatccccaaatgttgtgggagggatctggtgcaaggtaattgaatcatgggggcagttacccccatgctgctgttctcatgacagtgagtgggttgtcacaagatctgatggcctttttccccttttgcttggcacttctccttgctgtcgccatgtgaagaaggacatgtttgcttcctcttctgtcatgattgtaaatttcctgcggcctctccagccatgctgaactgtgagtcagttaaacctctttcctttataaagtacccagtcttgggtatgtctttattagcagcttgagaatagacgaatacacatggggactacacagatggctgagcatgatatttggtgcatagattaagcagaaaagatttggaaattagggtcaggaattgtttaagctttgaagggcaaagatggcttgaggaatagctcctgaggcctgtgggaacaactatcatgaggaaagactcagaaaatgagaactgggcattgccatacaacctggccagctcttgtccacggaggggattcctgtgtaacctctgtgtcagggaagagactggccactcagttgtctcctgagagcaaggctgagttgccccaagttgcatagaagggtgtctgctcctggaggggccttgggactgggctcccagatgtccgtaggggacattcctggatgtgtggtccagtgcatcctggagttgcagtggagatgctgccgagtgcctgtggttcaagaggaaagtggcagggtgggtttgggcatatagtctgttatttagattctatgctaacaaaggcaaaaggaatgttggcctaagatgacagatgattgctttctcccaaggttagcaggctaggtgggcaaagttggatagtagtctttactggcacttgcaggtcctatgggacaatgcaagacaggacatgtcttccaacttcctggtgtcagcgtggctcattgtgtccggcttctgaagacagccactcagttacatgcaggccatgggcctgcttgctctcacattaccccttccccctcacactaggagaagagtaatgtggttggcagaataataacccaccaaagatgtctgtgtcctaattcctggaaattgtgaatatgttaccatacatggcaaaggggaattaaggttgcagattgaattaaggttgctaatcaatgagcttaaaatagcaagatcatcctagattccctgcatgggcccaatatgatcacaagattccttataaatagaagcagcaggaagaagtcagagggatgcagcgtgggaggacacagctggccagtgctggctctgacgatggaggaaggggccatgagccaaggaaagtggtggcctctggagggaacgcagccctcctgaaaccttgatcgagcctagtaagatccatatcagatctctgacctccagaacaatgagataatgagtttgggttgttctaagttcctatgtttgtggtcttttgttacagcagcaataggaaactgatacaggcatgattacccacactgtagagattctcaacaaagacttacagaaaccacataagttgcccaaatcagcaacattcacaagcaaaaatgacagagctgccatttggtcccaggccctgcaactctagaatctatgcagttcgaccccctggtgctggctgtttgtcaggcactagtgttattttcttactctggaattagactcggcaaaagttagaaacacccgtatgaatgggagatagaggatgacccccgtggcttgggatgtgtcctgacagggacattgtgtcattgttgctagacacagccaggagtaactcaatataaatgcaaaactggagttttctggggaaggataaaataataatagaattaaactcaccatttgataaaactgcaagggctgtgtctcaattccacctggcttcctgtcccgggcagtgtggaggcagagttcaaacttaggaatattcagaaactgctgagccaaaggccatgaatatttatgaggtgtcagggctcgccgggtgctgtcatgttggctggaggagcatgatgtgccaggtttgggttgctctgccctccgtccctgcataatgaactgaagggtgccctgacttcagcttctccatccgtccatatgctaagctagcattaatcctttccctggggcttcatctcatatcactgagtttttttccaaatgccaccagggggaaaggttgcatgggcatctctgtcagcttcgtttttaacaaaatgaccatatttgtgtttttagctgtcttctttgtggcctaaggaattgcctgaagcattctcagggccagccataaggcatggggctgggctgggctgcgttggacagagatccctcattccatctcctcttctatcagaggaactccacatttatctgttttgctttttgagcttccccacgaggttttatttcaagaagaccatctgctgctacaaaaagcttgagaacaattgattaaaaaaaaaaaaaaaaccctatgatggtgaaactctatgggaaatttatcagacaataagtattgactttactatacaccaggcacttttctgtcaccggaacggagcatcgaataaaagagacaaagattcctgctttcaaggagcttacaattttagtaaagtaaaacatgataccctaaaaaataatcatggggggacatgtggatgcgcctgtcttctgggctttcttgggcctcctagattggatgttagcttggggtcactttcactcttggagcatgtgttttcttgccccttcctgttatttgatgaccttaggctgccccacccccagaagtcctggaagtcctgggagtgtcccttgtggactctggccctccttccccaggcacccaggtgcttctctgacccctgtgggcccttcctggggtgaggtggtgggggcgggtcacatatgggagcacagctgagggctgctttgggaagaagcagggatgaagcccctctccccgtctggcacccccagggtctgactgacttgtgatgagcacacctcttttcatcttggctccaagtcatttctcccaggatttcagccagattccatgggctggatcagggtcacgtgggctggactcggagtgtgtcgtcctcggatgactaaggctttgttccggcctgaccttgcctgcctggctctcttcccttgggaaaattctcttccaagaggctcgtctgtcaatcccccctcagaatgggcttcagccgggcagtctcaccagtttatcagacaagccctgtcttgcccccatgtcacaggtgcagcttttcctcatgacatgacccctccctacacaagtcttctgcccttaacctgagggggagtttctctcctccccacgtaggccacgaagtggagcagctgccctctcttcacttcacctccatgctcccaaacaacattgtcgcttttaagacagtcaccactgagaacgctgggcaagtcccagaggcttacgaaattttacagagcgcatccttagacctgcagactacggggggaataaagcctctccttcagtttgcagatggaactgaaagaatttctacacagtaaacagattcacctgaactggccgagtctcagcaaggtcttattgaattctaacacacagtgtaacagtcaaaagtaattccgcttttacctgggcctcttgaaggacagtaaagatgatctaatcttagtccctggcagctttccttaaacccactgcactcaccctccagtgttctcagaccgcaccctccccttccctggtcccccagcctcagccccggtctgcacatcgtgttcctcaagctttcctcccctcttggattggaggatggaaggttggaaaagctcacattaatacattatgttccggctcatcccttttttagttttatttatttattttttgagagtctggctctgttgcccaggctggagtgcagtggcatgatctgggctcattgcaactctggctcgagtgatcctcccacctcagcctcctaagtagctgggaccacagacatgtgctagcatgctcagctaatttttgtatttttttagagatggggtttccccatgttgcccaggctggtctcgaactcctggactcaagtgatccacctgcctcgacctcccaaagcgctgggattataggtgtgagccactgtgccctggtcccttttaaaaattcttggtggagccagttcaaactcccaatgtcgctcaatctggtttctctctcctgtgaagtcgctttcctctgccactgcagctccagaggcctgaggacaaatgtcaaggtcaagggtagcagagctgctgtctcgtggcccagactgacctgctggctttcccctggtccttgcctttctttcttaaggacagtggcttgcgggggaggtggactggtaggaacaagtcagatgttgttggcacttgtgtcttgtttcgtgcatgtgatgtcttaaacaattttattacattcaaagcagtgcattttacatgaaaacccaggtttctggcatgtcttgagaagctgggacatttggtgactccgtgtccccagggagcagtcagctgagaaggttcccttagacccagtttgtttcttcagttcacacagtcctgcttggcccacgcgctccttttcctgtccagcccctgcaggcatttgagttttcaagcttgcctttgttgtaatggctttggaatagcttgcattatttatagtgctcccatttagtttctgtaggccacacacattttgacccaagtaagaactgtatacccagatattaagaggggcagggaggagatgaaggtctccaattgcctacccttgtaattccttactgctggttcaagtcagggagattcttccaacagtgccccttcctcaaaatgcaggtggctggggaagatgatggcatggcttctcttggaccaggtcctggctgccctggacatcatttctgttgcttaggttgagtcgtgggttcatgtggggtctcgaacaccatcaggcaatggtggtgaaccccaccgcccctaaacgcgatgcagccttcttggagtgctttgctcagtctccttccacctgagcaaggcagctctccacaggcccctgccccggcactggcatgcaagaagcaaaaagaaagccttcacagcattatttctttctaagattcaagtgaaagtcggcacctaatggcttttggcacagttgtttcttctttagggacacacatattgtacagtggaattcaaaacatttctatggttaggttgtgctaaacagtataaaattcttccacattttaaaagaaggcatagcccttagctaaaccatggatacttcaatagaatgttttaaaactttttgtttttaaaaaaactatagattcataggaattgcaagaacagcgtagagcagatttgtgtgtgctttacccagtctcccccaatactaatatcttatagatttgtaatatgcgacgggaactcatgttaaaacctaatcccccctgtgaaagtattaaggggtgggaaatctgactatggtattggagaggtgggacctttgggaagtgaggatggagcattagtggctcttttataagaggagaaagagatacttaagccagcatgctcagtcccctcaccatgtgatgccctgcaccacctcgggactctgcggagagtccccaccagcaagaaggccctcaccagatgcagcctctagactttggaattcgcagcctctggaactctaaggaataaatttcttttctttattaattactcagtcttaggtattccagttatagcaacagaaaatgcactgagacagtacaatatcaaaaccaagaaattgacctaggtacaatccacagatcttattcagatttcatgcactcgtgtgtgtgtgtttctaagcaattttgtcacatgtgtagatttctataaccaccacctcaatcaaaatacagaactgctccaaccctcccaatatctctcatgctgccctcttattgtcacattcgttctcctctaccaaccctatgcaaccactagtctgtaaataaaattatatcatattcacccttttagagattggctcttttaggctgggcgcggtggctcatgcctataatcccagcactttgggaggccgaggcgggtggataacctgaggtcaggagttcgagaccagcctggccaacatggtaaaacccccatctctagtaaaaatacaaaaattagcagagcaattttttttaactgctgattagtattccttcgtgtggacataccactgtgtgtttaactcttcttccattgatggacatctgggctgtttctgtttttggccattatgaataaatctgatatgaacatttaagtacagattatggtgtggacattccaatatgacattttgtttatcattttcaagagaaaaaatacattgttctttgtagagaaattctcataaaaagactgacccctgacttaccttttacaacccaccccacatctcctccttctctcctccctgttagagtcattcacttaaaacactttcattgagcatctgttgtaagtgaggttgtttcacaagctgtaacaaatcctgcttcctgaagctgtattccaaacacaaacaagatcatatcaggtaagtgctctggagaagataaaaccaagcaacgaagtggagagtagggttaacgagcggtaggatggagaagaatcactggcagaacttccagaaaagtctgtgcagctatgtttcctaggcagggatgttcacacccttcacaacacatggcagagcaacacctctcagattttgatgtacaaatgagtcacaccaggatctggttaaaatatagattctggccaggcgcggtggctcacgcctgtaatcccagcaatttgggaaactgaggtgggcggatcacaaggtcaggagttcgagaccagcctggccaatatggtgaaaccctgtctctactaaaaatacaaaaataacccaggcatggtggcaggtgcctgtagtcccagctactcggaaggctgagacaggagaaccgcttgaacctgggaggcggaggttgcagtgagctgagatcacaccactacattccagcctgggtgacagagccaaagttcatctaaaaaaaaaaaaaaagtgcagattctggttctctgggttgggatggggcccagatcctgcatttcttagagctcccagggcatgctgaggctgcaggtcagggatcaacacttgagagtagcaggtgctaaattaagttatgagatgaagccccaaggagcacacagcaccttaatggtacttgatggtaatttcttggacgttgttaaacaagcatctctgtgtgtgtgtgtttatggaattggattcagggttcctgtgaattttaaatataaataaagagacctacttcgtgccaactctttaggactatgactccacccctgaaatatgtgttcacctttctgtctggaatgctttggtggaagtttttgagaggcattgcctgtgggcctttgctagcacacttacttgggaagaaagcccagccctggttgctggacccatggcttctcaggaccccatctcctcctctgagcctggccccttcagaaaagccctctgccattccaatgggcgtggagctcagcgcacctctggaggccacttgctttgggatttgcctttggagcctgaggcacgtttactgaatctcctctgtagggcaaactcatgtcctctgaggacccaattaaactttaaagagagactcgacttcaaaaccctttcttttcagtagcaaactccccaacctcccctgagtcagatttaaacaatgcctgcattttagtttgatatgcagttcttgcctaggagctcatcataggctcagaattaatttgccccattaatttaccccagaattaattgttgcaccttctcttccaactttttcctccgggatctcgcttgggtgaggccgtgtttgggaaggctctgtacatttcattctataaccagacgacttggcctgaaatggttgagcttaacaggggtggaggtggggtggggtgggagtggtggggggcagggcaggacaagggcttcgggagtgggagaggcttatcacttccccaaaggcctgcagctccggcaatgataaaagctaactctcagtcatcagcttccttgctattcataggcgggtccaaatcctcctttgccttccagcaaagagaagcttggaaattccttcagaggagagaccttgtttgtcacaggcagaagagccctggcagccggaagcctgatgaggatttgggtccacactgctggggctcacagacctgaagtagacaaggcctggcctgtggatggcggattctgcgcagcctccggcagggaggggttgggaggtggtggtggcccccttgttcccttttccaaccataggactccgcaggccccacataagcttggaggaggtgcctttttttttttttttttttgagatggagtctcactctgtcacccaggctggagtgcaatggtgcgatctcggctcactgcaacctccgcctccctggttcaagcgattctcctgcctcagcctcctgagtagctgagattacagacgtgcaccaccacacccagctaatttttgtatttttagtagagacgggggtttcatgatgttggtcaggctggtctcgaactcctgaccttgtgatctgcccgcctcgtgcagctgtgtttcttaggcagctgggattacagccatgagccacggcacccggccttgaggaggtgccatttttgagggttgttaggccccgcatgctggcactcaggaaaagccgtgcctctcttcttctgggcatctggctggactacacttcccaggccctcgcaggcagtgggaaccgagtaactgagatgggcggaggaatgaaggcagaagcgtggaaccccacggccaggcaggattcatcctctttctctctttctctctgtctctctctcggtctctttctccctccccttgctccctgagaaccctgtaagccacgtgttgaggatggcagcacccccaaagagcagcaagctgggtccctgaaggaaggtgtggagtagagtccccccaacctctcctcccctctgccctacagattgagctggaaacagaaacttctgcagtgttagaccagcgaggttccagtgctgctcctcccaccagccagccttccctgacaggtacagccgctgaagtcacaggacaggaaaggcagacagaccctttgtggggagtccatcgacacctggggttcatgctcccctgggtcctgactgcctgtcgtggcggcataactgggcgcagggcggggagagtctaaggtctaataagggtcttagctgctattttcagattatttcctgcataggccttcctgttcttcatttacgaacatgataattcttagctggatataaaagtctctatattcagtgtagaaaatgagggccatatgtaaaattagaaagaaaaaataaaaaatcatccattatttccttattcagagatcattgctggcaactttttgctgttccttttccagtctttgcaggcatgtacatgcaggtatatttgtgcacatatgtgtgtgtgttagagaacaaatacatttatatatagtatctcgctctcgctatattatattgtattttctttctttctttctttttttttttttttttttgagacagactctcactctgttgcccaggccggagtgcagtggcgcaatctcggcttgctgcaacctctgccccactcccggttcaagccattctcctgcctcagcctcctgagtagctgggagtataggtgcatgccaccatgcccagctaatttttgtatttttagtagagacagggttttgccatgttggccagactgttctcatactcctgacctcaggccatccgccagccctggcctttcaaagtgctgggattacaggtgtgagccagtgtgccaggctgagcattttcttatgtcattaaaatcttgaaagatagttttactggatgaataacattcacttaatggctatattctgatttgtttaaacctttttgcattgtgggcctctagagttgcttataatccactatatgcaaactgctgagcatctttgtacgtggatctttattcaaatctttgctggagccccaagatacaccttcaggcaaggttcttaggagtgaaattagtagataacagactatgatagttctttttgaacctcaggctaaactactttctggaaagaatatgatttatactctcaccacctgggcatgaggggaatgatcttcactctctttagaactgagaatacttttgcataatttttttgtatattaccgtattgaaagagtcaatagaagtagaaatcttattcaaaccactggttcttaatttatttgagggaagggggtttagattcatttaaagtcctggaaaaataaatggatcctcagttttcctttattccccccgaccccatgcacacattcagcgtttagaatggattaatgggggaagaggagaaaacagtgagaccaatgaggacactggtgagggagaatggaggctgggagggagtgggggcagtgaggatggaggggagaagatgcgtctgtgtgagagcaaggggtcctgctgaccacttggaccaaatgatgggagaaggggagagaggagctgacatttgggctttggacttttcaaattattatgttatttgttaacactgcaccaaaaccctcactgccccagaataatttgccttcctcccaccccctctgttcattgtccttgatccaggccttgtgttaagtggtgtgaatacaacactgagttcaccgactcccccttcccccataggaggaggagaagataaacaacaaataaaaaatgaaaaaataaagtgttcagcttatgataaagtggaataagaacagagaatgggcactatgctagagaatgctgaggggcatgtcagttatctattgcagtgtaacaaataatcccaaacttagtaactttaaacaacaaacatctattatctcagtttctgtgacccagaatatgggacaggcttaactgggtggttctgactcaagggcttttatgaagcttcagtccagctgttgcccctggctgagatctcatctaaggctcaaccggggctgaaggatctgcttgtaaactcacccatgtggttgttgacaagcctgagattctcatgggttgttggattaaggggctcagctctttgctaggtgttggggaaggtctccttcagttcctcaacattggagcctcttcactgattagctcataacatagcagctgccttatcctagagcaggtgatccaagggaaagagcaagagggcaagagagagtgtgcgtccaagaaggaagctgcagtctttttataacctaatcttgaaaatggcatactatcacttttgctgtcttctgttcattagaagtgagtctccaagttcagttcatatacaaagggaagggaactaatctccaccttttgcaggaagaaatagcaaagaacttgtggacatattttttaaaccaatataaggggagagtggggattggcattactttacatagggtgttcctatagattttaaaagatatatttaaaatactattgaaagtttattgcaataaacttgtaccagtccattagcccttagttaaaaatcttaaggcagatatttcagatttcagaatttttgagattttaaaaaagcaatacactgcacaaaacatatgttatgtaaaactccctagtgaggtctgaggcctgaccgtgaggaatcagggtgtgaggagaggcatgtggttgtggtggtgggcatgggaaagaagggtgagccaaggcagtgaggcatcacagggactctgggcttggtgagagagggaggaagggcagatgggccctgaggtctcatgccagtgagaaggaaggtcctgttgtcagacccctaaggggagctggtttcagggtaaaagactcttggattagatgcattgagtttgaggagctgaaggggccttcagggtagagaaatggtcccagtcactcagaagttatcatgaagacagccctgattggggtgatggtggcttcaccatgggatattaattaaatacattaatatctctacagtgaaacctatgaatattcacaccatgcaggataaatatagactttgaataacctcatgttagttaaggtcagatttgcatacaaacaaatttacgtcaaatgtagaaaagaacactttttgttttccagagcatttggattttgccattgcagataaggagctgtggacccataataaatctttaataatatactcatctaaagtaaggaatactttgttgtaaagtaaggaatattacttgttatggtctgaatatttgtgttcctcgagaattcatatgttggaacctaatccccaatatgatgatattaggaagtgaggcctttgggaggtgattaggtcatgagaacaaagccctcatgaatgtcattcctactcttattaaagaggccccagagagctgctgtgctccctctaccacgtgagcacacagtatgaagtcaccatctatcaacccaggagtgcattctcatcagacactgaatctgctaggaacttaatcttggagttcccaccctccagaactgtgataaataaactgttatggataagccactcagtctatggcatttactatggcatacaacaagatattgcctaaattatttctttatcaaatatcataaaaaattaataaaaatcattttaaaaaatcctaaaacccctcaggggattgtgaaaggagtttttaattacaaagattggaatctccagaggcaggaatagagagcgataacctaagagagggagattgcagccataccttgaaggtctttgaatgggggcctgagatctctagccttgatcttggaagttatggggagcccctgaagtatatcaaccagagtgcagaattgtgccttctgagccagcctgggatgtgcaggggaatgggagtcaataagtcttcttacatctggattcagcaaatgctctttccatgtgttccttgcactctgtgggaccagcactgcagacctgcagcagggcgacctggtactcctcctctcccggctctctccgtagtgaacgaattgtttaaatggaggcttcctcacacaagttcctcatcttagatcctttaaatctcaaaagtctccccagagcagacacttccccataggcactggagcagagagggatggaagctgtgaccaggcagacctgtgaggaatcagggtgtgaggagaggcatgtggttgtggtcgtgggcatgggaaagaagggtgagccaaggcagtgaggcatcacagggactctgggcttggtgagagaggaaggaagggcagatgggccctgaggtctcatgccagtgagagggaaggtcctgttgtcagacccctaaggggaggtggtttcagggtaaaagactcttggattagatgcattgagtttgaggagctgaaggggccttcagggtagagaaatggtcacagtcactcagaagttatcatgaagacagccctgattggggtgatggtggcttcaccatgggatatcccttaaaaggctcacccacaggactttggtgaggctcaagaaagaacctgctttataaaaggaagcacaagctaaataaaagctagttttgctgtgagctaagctgattttaattgtttctttatattggaaaagaaagaaagaaagtgtgtgctgggttgtgccttggtgaagctgggaaggggacaccagtgttcccattagagactcttccaaagtctttcaatgaggaaagggcagggcagatggtgaggaaacagaccagcttgcctcttgctagctaccctgatgacaagtttagagagaagctgaaaagggacagaatcatatattgaaatattaatttatgttttattttgcctctgtgaaagggtcaggaaaaaagagaaacatttttcttctccctctttaactccatcaccattttcttctttaagttccagaaaatctggactccgttggcacccaggttggagtttagaagttttagaaaagagctgagctgcatggcccaaaggtcatgtggggctttgggagccatgggacatgggtggaatgtggccaagagctttgcccaagttgggaaagggggcagaggcttttgtgtctcaggacttgtgggcaccttgccttgctcttcacagcatgagggagctggcaggtgcagggtggggtgatgcttccagggatggctggaccctaagctcagaatactccagcctgcatggatatccccatgtctatgcttgcacatggagcctgtcagaggtgactggtggtcatggacacgagaagaaacagatatcagcttccggacaatggcagctccatgggtagaggaaggagactcagaaaaggctgccactggatttaccatcagttcagtgctggtggcatacagagagcatgtgacacttgtttcattgaaataccaaaaaaaggcatttctcacatcttgtgtgttggaaaaagccacgctgtgtaccaaaccctactatagtactctgtcttagtccatttgtgttgctataaagaaatacctgaggctgggtgatttataaagaaaagaggtttcattggctcgtgagttctgcaggctgtacacaaagcatgctgccagaatctgcttctgcatgagggcttcaggaagcttccaattatggcagaaggcaaagggggcgtcggtgtcacatgatgagagaagaaggaagtgagagagagaggaggaggtgccaggctcttttcaaaaaccagctcttgggaactcatagagcaagaactcatgacagcaaggatggcactaagccgttcctgagggatctgtccctgtgacccaaacacacctcctattaagccccaccttcaacattggggatcatatttcaacatgagatttgaaaggtacaaatatccaaaccatattacactcctttcaagttaccttttctatcccagtgctctgagagtggtcgaactgtggttgcttttgtcccttattctgtttgcgttctccttatcaaccttgaaggatatgattgctcttctccaggtagctgagccctgtaagtagtttgcacagtgtctatatgcttccttctccttcttcaagctctcaggtgtcgcatttgcctcctagttaccatgtttcagcagaaagtttagtagttgttgaagtgacaatattcagacaccagatgtggaagtcctgtgacgttggttgcaaaaatgactgcagctctccgctgcttcctgtatgcacgccctttccaatgtgaccttggagactgtcctgtcagggggtgtgtagggggatggagtctgtttctcattcctggcacctggactatctttgtcccttgctctaggcagtagagtgtggcagaaatgaaggcaagctagctctgagttaggccttaggaggcagtgggcacttctaattacctttgaaatctcccactgccacaagctcaagaataatccattctagcttgctggaggtcgagatccacatggaggagagctgtggggttccagccacagacgtcagagaccaatcagcctgtagctgacccatcagtggagcaagcctagctgagatcagcctggccgtgcccaagcaccttatagacccatgaaaaacaataaactgttgttgttaaacatcaataaatcttggggtggcttgctgtgtagcaacagttgactgctaaagcttgcatacctggtgacagagtttggatgtttgtccctctaaatctcacgttgaaatgtaatcctgagtgttggagatggggcctggtggaaggtgtcgaggtcatgggggtgggtccttcttgagtgtctgggttctgtccttgcaatagtgagttcccttgagatctggctgtttaaaggtgtatggcaccttcctcctctgtcttgctcctgctctcaccatgtgacatgcctgcttctgcttcgccttctgtcatgagtaaaagctccctgaggcctcaccagaagccgagcagatgcaggtaccatgcttgttcagcctgcagaactgtgagccaattaaatctcttttctttataaattgcctggcctcagatatttctttatggcagcacgagaacagaccaacacacctgggcagtcctggattctccaggcgcatcacaaacaaaaccagttagacattcattcaatcccagagcgacttcctttctcattacttttttaaaaaataaatttttaataatctcaagccttcctggctctccatagaattcttcctagcacaacatttctattttaatcatataacctccaggattcagatgcaccaaatgcaacaattgatgaacgtctgaatctccactggtttcactttccagatccaggttgatctatgattcttctacagaatcataatctccatatatttatccccaagagaggttaaatcaggtgcttcattatctggagttctcaggaagtaaaccgtcagccagatgctgcttagatttatgcttctctggcatgtggtgcaaccggccgaatttctaaattaacatctaagatgtgctccaagtagtcttaatttgctttcttttcttcttctattttttttttttttttcacaaaaatagtgctgagatgcaggcatccgtgcctggttcctgcctctgtgaggctcaggaccaggctgtcttgctggcgtttgatttctcacacattggaagttcttcagttatcagcagaggcaagaggcatatttttatgctggggtctttgagtgtcacagcaaattaaatggtggtccttctggtaaaggaagaggctaagtgggaaaatatatgaaaattaaagcaatccactagatgtttttttctttttttttttgcagtaggaacagcatgccgaagtgaacactactgacttcctttaaaatttttcacaatgccttctgttttatctagaaattgagctttaagggaaaatagagtgacagagacaaaaggaaaagtgtaatccctttggcttcttccagtaagctttagaactcagcacccaacccttctgtaagacaacagataggaaaagatgccatggtctgaaaggagaagagaggaaacgagaaactaatattcattgaatatcactatgcagtgatattcagtgatcagatgctgggttacagatattcttccatcagggcgtcactgagtccaaacctgatgactctatggattttaaaatgagggcacagttgagacgccagcagttatggttttgatatctgggtctctatggaaaagggaagcactgggtcatgtttaaaagccaagaggcctcccactaggatgaagagcaatatttgattaaaaaagtaaagtgaaattgagaaatttagatagtgagtagtagttctgaggtctccaaagaatgcaaattaaaatttctgatgcttgtgaaaatatctgcccttgagatttgttctatatttatacccccaagcctgacctgggagagtgggtcagattgtatttcaaagtacttcctttccaaaacattcctagcaaaggatgaaagaaaaggggcagcccattgtgtagaagttgagtgtggcaaggagaatgaattaggactccaagattttgggtgcactgagagaggccaccatgatctgagtgggcagaaggaatctttcagggctacaacaggttcattttcaactgctgtctggaactggggcctcctggggtgacaacggcaggcagccctcccctgctgcagctgctgagaagggaagagaaatgactgattgaagacgggcttcgggctagaaactctgctaagcaccttcatatttacaatcctgtttaaccctaaaaagaaaccctatcacacaagactagttaccccaaatttgcagatgagatgaagtaactgagcatcaaaaacatttggtaatatgcctacctgagtgaagaagcagcattaggatttgaccttggatttctgttgctacaaagcctgtggccgtatcataagacatggacaagaggtattagaaaacccagagtccacaggcccaagaggaataaagcccctcctccttttccccaacctgagaaattgtgtgtgtgtgtctgtttgtctgtgcgtgtgtgtgtgtgtgtgtgtgtgtgtgtgtgtgtgtattttgagaggggaaggaagagctcccaggcacgagaaatgtgagcgtctctggagcttggttgatgtttggcatcatcagctttggaaggtgtagataaggacagctgggggtgaggacatggggaaaagtctgtggacagagcctggggcacacccacacctatggctggagagggctgacactggactgcacatcaggggccccagagtaagtcagcatgacagtccttgggtgagttttgtctcagttttcccagctgtacaatgggaaggtggccgaggaggtgaacgcaagtagggcttatgggatgggactgagagcatgtgggggagatatggatgctgtgaggttagtgggggctgagaagcagaaaagcgagacggggagtcggggtcctgtagctgatgctggtggtggcaggggccacacatgcatcctcaccacagccagcggcagggtcatgcttagagttcagtcagtgagcagttcttcaaactcagtaattatctggttttcgtcggctggcaaatgcctattgggcatctgctctggccccggcattccacgagcagttgggctgcacaatgacaagattgggccctatcaaaaaggacaggcatttcagtggggcgacaggaacgcagaccagtcctgcaagaggaggccctctcctcattgcctgatgtcctttgctctcttttctcttgtctgagcagtaagttgcttaattgcttggccacctgtcccccaccccttgccccaaggtggtcatgagacgaagcacagggctgcgttttgggtgcctctctcttcactcttctgccaaacaggcctgaactcatgatgcaatccgccgcctggggcaggactagtcaggtgtctctttttccacatcttctggaacacacctaggaggagtttcagaaggacccagaccttctgtgctgacccagggcccttccttctcctctctccatcccctgtgggatttgactatgctggtccaaggattttgttttaagcctaagccaggggttttatttcaactcttacctgagagccctgcagtaggggtgtctggtgcttcctcatgaatacaatagggtcatatctgtgcccacctcataggacagctacaagggtcccaggagaaggtcgcataaagcccttagaacaggctctgcacagaggaagtgctggtgactgtaatcaggccgtaattacgcagactggctgtgagtaaagagactctgttgcctctttggccattgcttgcgagtttagccttattaggagggaattccatggtgaggagatgaatagcagcccagatgctggctttcctctgggcccctgaccacagcaacagacccaagaaacctcctgagcaaggaaaagccagtgccgaaaacagagattatgtgcggggagggaggaatggagtctacattgagagcaccctggccttgggactcccatcaacaaaaggaggtttaatttcagaaggaaggtgatcctgggggcctgcatttatagcgctcccaactcatgtaattctcaaagtaagctcaggaggttcacagttatgaatgcaggggctcagacaggtccctccacctcattcattgtcacccgccattgtctctcctctaccccaggctcctgcccagggtgtgggggcgaccaactcttctgtctccaaaatgctattctattctctttctgcctcaacagataatacatttttctttggggatggaatgaaatgaaaactttctgaattttggcactgtgtctctttatccttttgaaatgccaggctctttgctatttttgcttttagctgagatattgtataaaggtccccaaatgtgacagggctctggttgtccgagaaggtttgtgggttgataatataaatagaagctggtcctttcatccagcccaatctttagagctttttgccagggctcctgtttggctcatgttcatgtttgctgaactccctatttattttggactttggtttttagaccgggtgactctgaatatcaatggcttagcaacgtgctatttttcatgaacacacccccaaagtttactcttttgactgatatttgtgttcttaaaacaaagacatttaaaaaataacactatgtgcaaaaagatgcttatctgtatttatgtacagatggttctcgactatcttggttcaactgaacaattttttgactttaccatggtgtgaaagcaatacagtggaaactgtactttgggcacctgtacaactactctgtttttcactttcggtacaatatttgataaattacatgagcaattcagcactttattataaaatggctttgcattagaggattttgcccaattgtaggctaatgtaagtgttctgtgcacatttaaggtaggctgtgctaagctatgatgtttgctagatgagacataaaatgcatttttgacttacgatattgtcaacttacgacgggtttattgggatggaatcccactgtgagttgaggagcatctgtatatatctctctctgtaaatttcaaagcagactaaatgtgcagataagtcaatgacagttccccatgagtagaatattataaagccactgcaaaacaacaaagcactacaggcaatgcttgtgacaggtgaaatgggcagaataccaaaagagtgtgaaggctttacctccaagtagctaatgttttgcattattcacattcaacagagccaccatttattgaacatctgttgtgtgccaggcacatagcaaggtgttttcatgtgcctttctcatgaatgcttgtggaaaacatgaaacgggcatcatgacttctgtagacggaagtgttcaggccaatggtcagggtcagggtatatggaaggaattcatttgtctggcagggattggttaacgggacatgagggtctgttccaagctgagattccatgatctagccataactcatacataaattccactcatctctctctggaagtaggattccagtcacgtctctctggacccctctttgctttcatcatagtcctggtagcaaagcaactccaagtacactgaaactaaaggtgtgtctgggaaagttggccaaagtggactggccaaaactttatttatttatttatttatttatttagagacagagtctcactctgtcaccaggctggagtgtactagcgtgatcctggctcactgcaacctccaccgcctggtacaagcaattctcctgtctcagcctcccaggtagctgggattacaggcatatgccaccacgcctggctagtttttgtgtttcagtacagatggggtttcaccatgttggtcaagctggtcctgaagtcctgacctcagatgattcacctgcctcggcctcccaaaatgctgggattacaggcatgagccaccatgctccacgtatttttaaaatgtaaacagaccataaacaatgtacagatctcagaagagatgaaggggtagaaagtaaatgcttgttccttttctgttggccccagacccccatgtccctggctcccttttttagtagcagtcactgctgccacttcttgcctcaccttctagagagtccaagcatataaaatattctaaatatgactgtctttatcccttgctttttacacccaaaagcaacacgtttctttttcaaatggttttctcccttctccaatgcgacatctaggagctcattccacatgggggcatatcaatctgcttcattctttttaaaaggctgcatagattcaatttattaatttacttaaatattccttagcaaagggtctttagattgtttccaatttttcctaatgcaaacaatagtagaatgaatagcacagacacgtatcatttcgatacatggggacgtttgtacgataaattcctggaagagacatgctttgtcaaaggacatgagaatttttaattttccaaattacttccataaacgatgggatagtttaatcccccatccccctcagtggtatttgaattagtctccagactgttcactttctggttcaatatatgctagtgggctgggaagaacacaggttagtgccagtggaatggacctggccaattcacttctccgtgaatctcaacttccatcaccgcaaaaatgaaatgccacctgtccaagcaacatcacaacttctgtaaagactaagtcagaaagcgttcagtgccataacttgtcaactctgggagtgtttgggagtgcctttggtcaactgcaaagcttaatgtgtgtgcttctccgggccagcatggaggctttgtgctctcctctcatgcgaggttctgttcagtgggagtcataacacctttgagcatcctcagaaccagataaggaggccaagtgagtgcacggtgccaccgtggaaggggtttgtagaagtcataggttggtctgatttccctcttaaggctgcaggctgggagaaggtcaaacaaagctcagagcggctggatgtgtcatcccagcaacctggccatgcctggtgaaatatgacaatgccaccctcactaagtaaagagtacagtgaccattgaaccctacccatggcatctgtgaaaaactgcttggctgccgaacaccactgtaggagctgggaagcataaatttcaaatgttcatgtccttttggggagaaaatgtgagttgaattctaacttgaacattacattcagaataaagttattagctgagtgcttgttttcttgcagattctactgtagtgttacaaaatagagcacctaaatagctattttttttggaaaaaaatcattattttttctggggggagggggtgggggcgggaatggagtttcactctgttgccaaggctggagtgcaatggcgccatctcggctcattgcaacctctgcctcccaggttcaagtgattctcccacctcagcatcctgagtagctgggattacaggctttcaccaccattaatttttgcatttttagtagagaaggggtttcgccattttggccaggccggtcttgaacttctgacctcaagtgatctgcccgcttggcctgctaaagtgctggggttacaagcatgagccactgcgcccggcccattgcatgccttttaaaagttaatatttcatatcttaagcttaaaatagtaaagtaactatatattatacaaacttcagtcaatatagaagtgtgtgaagtgtgagactcctcaattccttgtccctacccgcagccccaacacctacatgcactagcaggggaaagttagatctttacctttttgaaagcttttttggggtgcatattaaaaactatgaatatgcacatgtataagactatataacccttttacaaaaatggaaccctagcaacacagcgacgtgtaggttggttttttatgtagatgatattttgatagagggtggcgatctttagctcctagaaccaaggatgcatcatttgcattttcctttgtgttaatcctgcacatacagagtgtgatgttgaatttttcaggcacactcaccatggtggggggaggggtcagagagtccaggcaataccctaagagaagcgagtgaccaatgctgtgtatcctagagaacataacagaattcaagaggcataatagtcatcttcaaatacctgagagattgttagagggaagaaccgttgctccattctggtggctcctggaggggtgtctgtgaccagctgatggaagcttcagggtagcagagatcaatagacccgaagtgacatcctaagaatgttggttttgagtcctactggctgagttccaatcttagctcttctacctagtagctgaataaagtccctgtgcctcagtttcctcatctataaaatggggtaagcaaatacttcttctgtgctgtttctatgaaaaataaaagatattccatgtaaatctctcagactagtacctggtgcagagtgagctccccccataaccataatggtcctcccaatgcttttggttggtcagcgggctatctatgagctctctggtcattgatggccatattagctttcagtgctcaaaagactgacagtctatatccctatgcagcacgacttcagaaaatcccatcttttaccaggtttctgtcattgtgaaactccccaattcctccccatttctgagaataccctgcctccagatgtgcctgatcctcaagtctgtccttgttctttccctgttgctcagctggcggctgactcctcccctgctctctcagatgaatgccatttactgaaccaaagttggcttcctccaggctgggtggatcttccctgccctgcttcacccaagcatgatcccaggcttctcttaattccccacaacacagcaaaaaacatactggattgtttaacaaagcttactccatgtagggaatgccttggttcctgtacccacccctgacgtcacctgtactatggtcatagttgctgtctacccaaggggacacatctgcaggtgtggcgacaccatggaatcaaggctgggttgcttatgtcctttaaactgtggtcacttggctcaaagtccagccccttggggcccttggccagatccatttccttattcttcattctactccagcctgggcaacggtaggctggtaaattctgtctcaataaacaaaacaaaaagtcagaaagccatgactgtagcgtttgccattttttttttttggcatgtaaatactctcaccatggtctgtttcaagctaccaacagcttaacatcttgtttggaaaatttctgcctgtttggttattggccttccaggatgcattgctaggcagaggcatgtgtggtgttcctcgtggctacgttggttctgggtatgatatgggtactgacaagcaagaaaattggaagcaaggagctcatttcaccctgcacagagtttctgtggcaatttctcttgtcttgagtttccaaactagaggtctgggattgaatgaagtgaatgggctaaactatctttttgttttttttaactttaatatcctgtatcattgtcacaatgtagccttcttttcgtgtatctgtgagactcctcccttgaacgaacctcaaagctctagtttggggatggcagatagggcaccagggccagttttctggaaccatctatgctatttttatgtgctggatataaaagactcatgctttttgacctttgcaggtacttgtgaccatcacacatgcttcttccataaagtcttgtccataaactattatccaccaattgaaattttgtttaagaaataaaaaaggagtaaaagtccttgggactcaatactgaggactattttcggttcacatgcctttccctccaagaatcctatcagtcagatttctgggttaaactttattttcacccagtattttcaatctctaacagaataaacagcaaccccaggaaatagatacatctgcagctctgcaaagaataacattccctcccctcccaggcggggagagagcaccgcagtccccactcccccaagaaggaggccagatgcaagggagtttcctttctttggctggtcttctaagcaaagtgaagaattcttggagcatgagtcatctgtcctgattccacgcggcactgcatggccaggacctcctggggaagaggaaaagtgagaaagaggctgtattagtcagggttctctagagggatggaactgataggatagatgtatatatgaaggggagtttattaaggagtattgacttacacgatcacaaggtgaggccccacaataggccgtctgcaagctgaggagcaaggaagccagtctgaatcccaaagctgaagaacctggagtctgacatccttcaatccaatcaagttgacactcaatattaacctacagaggcgacccaccactcatggttctgtgtccctgagtagggctcccagtcactgcccatcttctccagagctctgcccagttgtcacttgagggttgtagttttcaaagtgagacttaagaacatgggactatatatatttatgtatatatccagcagtgtagagctcagggttgtcaagaggcccagagaagaggggagcaatctgtgcctctttctgccttggtcctgggccaagggccatgtgcgataatgaacgggtcatggccctgatgggtgcatcttaaactgcagtgaagaactcaccctcctcttctgcagagagtcaccagggccaacccagaggcttcgggaagcatacctttcaaaagagatgaggaagttctggcccagattctctgaatgcaaatattctctattggtaaaaagaactcattctgggacaaatcttcattctgagttgtaggcaaattacctttgtggtcaccagacagtagctctgccagtttgttttacagcaagtatgtaatttaagaggtggacatgcccattcccaaaggattctttactttgtcacgagattcttgacacaggattgcataaggttttccaaggtttgctgcaagttcattcactacttggatggccagaaaagcctgcgatgtcaacgtcactgtcaattaaggtcagtcaggaatgcaggaaaaggccctttggaattgccacccaagtcttccatctggggtggttttgctaacaaacaagttctgcaggacccgatgccttaggacattagtgcagtcttccttgtcatttaactttggaattgcttaagtgggtttcttcaccatgactcttctcaggactctgcatatgaaaatttgtgcgtgtcctagagccagtcatgttacaatttccacaatcttatgtgactatgtcaccctatggatttgcatctatttttactgaccctgttctgaggaatccaattaagtagctcaactaccaatcatgctccacaaatcagctggtgtttagtgcaggaaaagctcttctgaaaagtgtgcttgtttgtttttatacacattgttgatagggtaaataactcttacatatatgctagagacttcctgagaccccacctggtggagcccgataaccccagagaaggatttgcttaccctgctggtctcatttctcccttggaatcctgccctatctgaggagctggtcaggatgcagcggggagctggcatctgtgcaaatgtcacactcaccatcatgtcatccaccccacgaccccttcctgaagaagacacaacctcagtttcttcaaatgcctgatgtgttagcttggattctatcaaacaaggacagtggcagagttttggttttgttataagaagaaacgctgcgttgtgcgagtggtcccagtgtgcacgtctggggtgtgcttcaggaaaacgttaggccaatgatcaattcccaggtgtcttgacccaatcagtttattagaaacaagctttgtttccctttcttacaaatatcttctccaccactcgaagtcctggacctgcctggtttcagtattgtagtggggttctcttcctgtaggtgctaagtgggaaagggaatttgacagccaaccaggctgtttgttttaaaacagtcatccaggttaggggtggtgaacataaaatatgttccagaaaggttgtaaaatgatccttcccttggtcatctccgggaaaccgtcttctgaaggtcatttttagaaacaggattctaaaatgaattaaagcagctcaccaaatagcccctagagtcagaatccacttgcacttgttatcataatgaattctcagacacaagagtaaagtcaaatactagaaaacggttttaaggtgctttatttagctctttctgtgtgtgcattgtttattggcagaattctcaattcttctcttctgccattaatattgagtgagcatgtgtgtgttaatcaaagaatagcacttttgggggatacattttaagggtttaagtgtaattatttagtttagaattggctggaatataagctcctcggtggaatatgtgggaaattatacaatgtgtattattgattcaccattgcaatacaaagatgaaccccttttttgtgtaaaaatcagtataactgctacaatatgagatatgcagtagtccctctgctgatgctgaggagactgtcagctctgtgtatccgaggaggcattggttccagaatccctatggataccaacattcatcgatgctcaagtcccttctataaaatggcacagtgtttgcatataatctatcctcatcctcccataaaccttcaatcatctctagattacttattatacctaatacatgtaaatggttgttgtattgtttttaaaattcatattattattattattatttttcccctgactatttttggaccacaatgggttgaatccttggattcgggtcctgtgtttactgtactgaaaatgtcaacagcaaggatcatggtaggatggaggggtgttaggggttgggccctggagtcataaaaattgcactgtgtcctggcctctctgtttaccagctgttgaatcttgtgcctgttacttaatttctgtgagtcccacttccctcatctgtaaaatgcagagggcactagtaacttacctcatggtctgagaattctttcactcgctcgttcaataattgattatgcaccaaccaggcactgtcaccagctcggggaaataggacagaggcagcatcttgtgaatattcaatacatattgactctttttttttttttttttgagacggagtcctgctctgtcgcccaggctggagtgcagtgacgcgatcttggctcactgcaagctccgcctcccgggttcacgccattctcctgcctcagcctcccgagtagctgggactacaggcgcccgccaccatgcctggctaaattttgtatttttagtagagatggggtttcacctgcatattgactcttacttcccaaattagtaggaagaagaggagaggtgctcttgccttataaatatcccttcccaggtgggcgtggtggctcacacctgtaatcccagcactttgggaagccgaggtgggcggatcacctgaggtcggaagtttgagaccagcctggccaacatggagaaaccctgtctctactaaaaatacaaaattagctgggtgtggtggcgcatgcctgtaatcccagctatttggaaggctgaggcaggagaatcacttgaacccaggaggcagaggttgccgtgagccgagattgcaccattgcactccagcctgggcaacaacagtgaaactccatttcaaaaataaatacataaataccccttccctctccctctggggttttcttgtgtatatattcactataacttctgtaataaaaaatttccattgtgaggaggagaaaggtcgcaagatgctctccagtgagttatagcctgctgaagtgcttgcaaatgacatcctgtaaaagcagtgtgcgaggagcagttacggagatgtttctctgaggatttatgtgtctcatggccctctgagcacacacttgctggtgcccctctccaaggtccctctctgaggccacaccagtttgtagcacttactgccagtcctgtggctccagggctcactacgtacactgcaactgcccttccttcccaggactcactctgtggctcgtgacctcagataaccttggacgccaaatagatagggaagccctgggatttgtgcctgtcagggaaagagagaacataccctctactttgctcataatcaagaaatctgatttcacaattggctacagctaaagccctttgatgaaatgtttccaaaacactcattaaactgttttggaaaatgtaaagatgggcctgtagcgcagactgaggtgtgtgcatatgtgtgtggagttgagactcaactgtgctactgggaatttaagatgttagaggctggctgggggtggaagcaaagggagaacaagaggaaagagggtggtgtatggagatacctggcagaggccaggatctaacaggaaacagtagccataaacaatgccctgtgtaaaaccaggcaccacatgtttgggtcgaggaggcctggcattgagtatgaagttggctgcctcatgatgggccactaatagccttgcatccgggaaatgtgagggacaaccggggaggagtgtgtacagcagggcaagctgactgcagagggaggctgacaggggctgcagctgagcgccacactgggctgctatctttatctctatgctcacaggtaattttaaatttgattgtcaggggaaaagctatatacatggaaatgctcctcatgtcacttacaatgacaaaaaaatagaagctctggatttctatccatattgaaatggttaattaaatgtcagtatttaatagtcatggactgttgtgcggtcattaaagcagatcattatgaagactggggagcaacatgggagacaattatggtacacgaatgaaaggaggatatagcatcttacacccagtacgatggcaactaataacactcagaaccgtgtcatcgagcacctacctaccatgtgccagggaggaatggattctggaccatcagaaaaggtctttgagaatggggcatgctagggagtaacagagcaaatgaatatgcaatgagaaatcatgaaaaattctaaataaatggccaaaaaggtaatatgtaacgaaaacatatgaaagttctatggatataaatagggcacagtggattcagaataagagagaatagcctacttgagaatagctggctgggaaccaaccctgcaaatcaacaaaaggctggaaggaacacatgcaagtcagagcaaggaaacagaggttttgtgtggaggtcatgtgggtgcctccttgggttcaagtcctggcttctctacttacctgtgtgggaccctgggcacattccttaacttctctctcagttttctcatttgtaaagtggggttaacagtatcatctaccccttagggatgaagggattaatgcaggaaatcaccaacagctagtatataggatacatgttcaataattgttagctattatcattgttgtattatttttttagtcttgactttcaaaaacaatgtattaatattgcacagataattataatgtctaaatataaagaaaataatttttaatgtgttagtctggatcttccaattcctggacggttgtgagtgtgtgtgtttgtgttgggggagcatatcctttggatgtgaacggagaagttggggccttggttgtcgctggcagctgattcatgagggtaaccattttatcttgtgagggcagccatcttctatcccaagggcagccatcttctatcccaagggcagccatcttctatcctgagggaagctggcctgaggatgaagccagaatatggagaagaggagaaggagatggctgagaagcagaacggaaacctgaactgcatttttcttagagcaagaattacatcaattcttcaagccaagttgagcactgttggtttctgctacttggaactgaataaactctgacagatactgtacagggaacagtacttggggagctccacttcatctgaggccttcgtgagtggcttgtgtcacattcctggctgttcaggcatcagtcctggtttcctggtgagctctctgctgactccacccagagctcccttgcttccgtctctgcagcagctacctccgttctcacacatggcttcttctg

SEQ ID NO: 245 - DNA, 6523 bp, Homo sapiens
gcagtttgatctcagactgctgtgctagcaatcagcgagactccatgggcgtaggaccctcggagccaggtgcgggatgtaatctcgtggtgcgccgttttttaagcccgtcggaaaagcgcaatattcgggtgggagtgacccgattttccaggtgcgtccgtcacccctttctttgactcggaaagggaactccctgaccccttgcgtttccggagtgaggcaatgcctcgccctgcttcggctcgcgcacggtgcgcgcacccactggcctgcgcccactgtctggcactccctagtgagatgaacccggtacctcagatggaaatgcagaaatcaccgtcttctgcgtcgctcacgctgggagctgtagaccggagctgttcctattcggccatcttggctcttccccccttaaatttttatttatgtatttatttactttttcatagaaccaccaagtccaatacaatacattttggcaggagttttcattgagattacattgaatttatagattaaggtaaaatcaatatttttctggttaaaaaaactcctatcccgaaataccctgtttttctctttaggtttttagcttttggttaggcgttacagaagatttctttatatatgcatagcgcattacttggtagatatattttaatgtgttttataattcttgttactgtgaatgggatagttttttgaaaataaaacttcttatagtggaaagtttcaaaagcaaaggcaacttgtgtgaggggaatgaggaatccttgtgttccccaaaccaagctgagtcatgcccactcttcctttctccctacgccacatactcctttctacctccccagttattttgaagcaaatcctggatttaacattatccaccattggctctttcatgttaattttgggcctgaaaacttacttagctttcttattcgttttaataacatattgttaatttactttgctttttcaggtagagacacttttgacttgatctctgcagtcctcaacatggtatgtaacacaagataggtccttaatacttgcatttgcttggttcgaaactaaacgcgtgaccgtcacgatgacatctctcagcttgctctcatgtggcaccactgggtcatccttcccatcccatgacagttgttagactcaagttcaggtttagttggtctatcctagccccccgtgttgtttaccattccacagacaatgcatttcttggctactgggaaaaaacatcctgcagtgtgaaccaatctccccctctccctgcctagccctgggtctcagtttgcagaggctctgccttgggctcattctcacagagcagcagcagccgcagataaaagtggggcaaggttcacctgagcacaaagcagagcccggactggctaataaattatgtagagattctattgctcagaacctgaatccattattcagctttaaaacaggaataaaatatgcaaatgcagcaggcagaagtgcacacacagcacacaccatgcttcagccttggcaatggctgggcccactggagtttcagagacagacactttatttcctctgcctacgagtgtgtagaaagagacagaaatctcagccatggcaaaaaagcaccgggccactgtttatcttcagatctggccttgggagacatctttagtggcccccagcagcagagaagtcaagaccagcctctggggagaggcttgggtcaacctgtccttgtctttcccctgaaagagggaaactctttgatggcagtttcaatgcaaagttgtgcccttcccgatcccattctcctataaaataacctattattggtggcatccatatatgaacataaatcccctttgacaatttttgtttgatattttgggttagcacattctgctacttattgggtaaggtagtcatgttttctttactctgatgttgacctctttctatcaagtaagttgctgagacgaggctgggcgcggtgggtcacacctgtaatcccagcacttttggaggccaaagtgggccgatcacttgaggtcaggagttcgagaccagcctggccaacatggtgaaactccgtctctactaaaaatacaaaaattagccaggtgtggtggcgggtgcctatacttccaactactcgggaggctgaggcaggagaatcacttgaatctggtaggcagaggttgcaatgagccaagatctcaccactgcactccagcctgggcaaacgagtgagacaccatctaaaaaaaaaaaaaagaggtctacattcagcttgtctactcctcagtcacgattttaaggttctcatccataagagaggcctgaggcttctcagttttaaaaacgtgtcctcatggcaactcccacaccatccttgactctgatcccccctgcttcttctctggctttggtatggctttctttggttctgccacccaaagtgaaactggcttggttgtgtgcctaggctgggaagatttaatctcattgaaaaagtagctgctatttaatgaaaagagggctggatttgaaatctgaaaatatgggctcaaggcctgcaagtacaatttactgctggggccaccctggtggagccgtttcgcatcctggagccgtcagtgtcatggataacactgaactcagtgaactcagacctttggtacaagagtcagacaggatgatgggtgtaaaagtattgggtaggatgtgttgtttatcctcatatcactaggactgtatccggctgacatgcaccagaacacattactggttgttaaaatgctgaagtatttctgtgccaggtcagaaatagctgtctttccaagaagccccacacccccaatgtcccagggttcctcagtgctcttcccacctcgacctctcgtttactgcccctgcattcccactgtcctgcaacgaaagagttaatggctggtactattcccgagactcacaattttctgcctttggctccaggcaacacacatttattttcagcattaactggagcttaaccccaatgttaaaaattagaatctgcagaagttaaaattggccgcttaaggcaaattctctctccctctctctgaaagtatgaattactgcttctactgtctgggtaagatgaacttgatataatagccccaatcttgtttgttccaatagaatatttcatacggtcgaagaaggctaaattatgtgttttgaaattccctgaagctgcaattcaagaagtgtataattaagccctggcattattaaggagtagaaaatatttttcttccaactttcctatggtttaaaaactattcaggctttggatttttgtgatagcagactaggtgacacattctaagaactaccgttaaatggtgaacgaaagtcaatgaatgtggccctcctgctgggagtaaaaagactttctcacagctttgcattggcagcaggcgtaggtattcccttcttggaggcggccctgagaatctgtgacaggtgcgacacttttcagctacagtgtctggaaaagatatggttcagccttcagatcccttcctggcaggggtgacgagagtgggccgtggcagtcattaagttcattgtttcagtgagatccatacctccttgagaactgcttatgtttctctaaagagataacgtcactaaagggtgaaggcttttaaggataaaatcacacaaaaaagaatatattcttgcattgcttagatgttgttttccgtccctggggctgttataacaaattgccaaaaacacgatggcttaaagacaacagagttttattctttcacaattctgtaggtcgaagtctgaaatcaagtgtgagcagggccacatgggcccattctgaagacccgaaggagagtccccctttccctcttccagcgtctggcagtcctaggccttctttggttgacggcagcctcacttccatctgtgcctgtgactcacatagccctcttctcaaagtctctgactttctcttctcttaaaagaacacctcggctgggtgtggtggcacacgcctgtaatcccagcactttgggagccccaggcaggtggatcacctgaggtcaggagtttgagaccagcctgactaacatggtgaaacctcgtttctactaaatacaaaaaaattagctgggcatggtggcacatgcctgtaatccaagctacctgggaggctaagacaggagaattgcttgtgcctgggaaggcagaggttgcagtgagccgagactgtgccattgcactccagcctgggcaacaagagtgaaactccatctcgaaaaaaaaaaaaaagtaaaaagaatccccaaaaaacccccacacctgctgttgagtttagggcctctcctcaatgcagagtgctctcatcttgagataacttaatgatatctgctgataaagatcctttttcccataaggtcacattcaccaatactgaagattaggacatgaatgtatattttggagtcacaatttaacagactttagatgtatatttaaaaaattcggaagataactaagggattgattacaatagttatctatctggggagagggcggaaagagaggataaggcagcagaggaggaagggagaattttgcttctatttcattcttaaacaatttaaagttttgagtctggtaaatctgtcacttagtaaataattaaacaagtaaatctaatttaaaatgatacattttcatttttatacttttttttttttttttttgggacagagtcttgctctgttgcccaggctggggtgcagtggcacaatctcggttcactgcaaactcagccttcccagttcaagcgattctcctgcctcagcctcccaagtagctgggattacaggtgtgcaccaccacacccggctaatttctgtatttttagtagagatggtgtttcactatgttagccaggctggtctcaaactcctgacctcaggtgatctgcccgccttggtctcccaaagtgctgggattacaggggtgagccaccatgcctggcagtcagtttcaatctttttcaatcttttttttttttttgagatgaaattttgctctcattgtccaggctggaatgcaatggtgtgatctcggctcactgcaacctctacctcctgggttcaagcaattcttctgcctcagcctcctgagtagctgggattacaggcgcccaccaccaggcccggctaatttttttgtatttttagtagagacggggtttcaccatgttggccaggctggtcttgaactcctgacctcaggtgatctgcctgcctcggcctcccaaagtgctaggattataggcatgagccacagcatggggcccagtttcaatcttttaccaatgaaaacctgaacacaaaacaataattcttaaccaatcatgatgaaacacagtaacttttttttttaataaaaggaagaagaaagtgttgaaaattgacatctatgtttacatatcacagcaacacaaagtgccagcaaaaaaaaaaaaagtggaaaaatgaaagtatcttggccccatgagttttgctctgcttcccactgtcatttattcagtacatgtgtcactagatccaggacttgctctagaagttggaggaagtcaatggcactgtgagaaacgtgaattaccaagggactctgtcatgtccttcgttactcatgtgacttccttacatgaaaggaaaatagatcctggggcctccaaatcactcagctaaagggaaaagtcaagctggatctgcttagggcaaacctgcctcccatttattcaaagtcatcccactcttcactgagataaatgcatatctgatggcctcctttggaaaggctcatcagaaactcagaagaatgcaaccatttgtctcttatctacctatgacctggaatttcagtattaaaccaatgtttatcttgcatatattgattgatgtctcatatctctgtagagactacatgaaaattttgttgttgaaataattcgttgtactgagcttcaattgaaatgcttaaataccttgaaaacatttccatttttgcctttactcaaatcaggtggtggctactttctaatgaatgcaaatcccagtatgtgaaaagtgtgggttaggacaataaaaggggaggtgacaccattttaatggtttctcagaagctgtgctccgatgtccttgggcacatgtcatcagtacctcctgaggttatgtcacaggtgcatgtccttaactttggcaaaataaacttcctaaattaactgagatctgtctcagatattcaggcttcagagctatgccagctaaccccttatgctgaaaacgaggacttagaaggaaagggcaagagagccagacttgctttttccttttttttttttttttttaagtctttccttattcatcaataagccaaaagtagaggttgttagtagaaaatgtgtgcaccaagaagtgaaataaag

SEQ ID NO: 246 - DNA, 70 bp, Homo sapiens
acacacacacagagagagagagagagagagagagagacagacagacagacagagagagagagagagagag

SEQ ID NO: 247 - DNA, 646 bp, Homo sapiens
attttgcttaaatttaaaaaaataacattaaaacttagtttatctttccactgagtaaaactgagaaaaagttggcttttagatcatatatttatttaaaaaaataaaatgggaaattgacaaagttaccacattattctgcatgctaacaggatttcccaagcctgtgagagaatcatttcttgagcaattaaaaaaaaaaaaaaaaaaaaaaggacttcctcaacaatgtaaagataggaaacttttcaatccaaattcaaggtctttattactagttccacctcacaagctagtgggatgtatctgtgtcacaagctgaattcctcagtaaagaaagcttgagaagacactaaacaaggatgttactaaaagacaatgatttgttaaaattataaagcaatcatcttttggcctgcaaacagtcaacattagaactctccaccactgcggatctggctccccatcacagtattattctgaatccaggataattacaatcacatggcatttttttctgcatgctttcttggcccaaaccctgcatgacaacatatacaatttacaagatgggacttgaaattcccattctcacacaggatagttagggcgtgttaccaataataaagaataaaagttatacaac

SEQ ID NO: 248 - DNA, 733 bp, Homo sapiens
caagagtctacccgcagcaaaaagcccagattgttgatgtctgctgctgtgtcagctggcaaaggtaccattgagactgcctgccagatccctgagatgtcgaggtaagcaaacccaggagctcatattcagagctaagtgacccttagaccttccccgggcattgtcaaatgcccagataccagtgaccaatgctcaggtacccaggatagagaggactctatctcagaggaatgaaatgacctcaattcctgaggaagaggcagagggagacagtatgaatgctggccttgtttctaagtctatctccaaggttctctagggcaaacggccatttggagaaggttaattgagtctcaagcttctacaagtcctgaaggtctgagtgtaaccagatagtgatcatggaatgggtgccttttatattccaggtgctcttgagatgaaggtgagggagaatggaataaagaataacaatgcataagggaaactttattgcatagtggcaaacagcagatttggctgtttgtcaaatctgcaatcagccgatttgggactaggagtgttaggggtagtgggttagaaagaatgatttcccttgggtcatttatttcctcttgctctctctcccagctacctaaggtacatggacctcatcagtctgatgacctatgacctaaggggctcctgggagggcttcataggcgaggacacccccacttgcaggacctaa

SEQ ID NO: 249 - DNA, 64 bp, Homo sapiens
ttgggaagatgagaaagttctggagaatgatggtgacggctgcataacagtgtgaatgtgctta

SEQ ID NO: 250 - DNA, 444 bp, Homo sapiens
caatgttgagaggtgggatatttaagagatgattaggtcatggggctcagactttatgaatgaattaatgctgttttgcagagtgaattatctggagagtgggttactgaaaaaagaattaagccctctttctctctctaagtgaaataaatcagacacaaaaggacaaatattgcatgatttcaattatatgaaatatctagaatagacaaattcacagagattgaaagtatattagaggttaccatggaatgggagaagggaataatggggagttattgcttaatggacacagaatttctctttgagatgatgaaatgatttttggaaattgtgatggttatataagatggtgaatgtaattaatgccattgaattgtacactttaaaatgatgaaaatggcaaattttaaattatatatgttttactacaatttttaaaaa

SEQ ID NO: 251 - DNA, 18401 bp, Homo sapiens
gatgggaaatggctgacagcaggataaacaagcagctccctttttggtgagcttcaggggaatcaggtggacagaatcaaggcttcaggtatgctcttcagaggctctgtggagtggtgggaggctgtaaaacagcactggagatggttgtggttctcccccagcaaaagcaccggcaggaagaaaggcagattggcaaacagtgtgggcccacagtgcgagccaggggagaagccatcaggtgacacatcaagccgtgagaggcagctggtcagggacccctcagttccccaccgtcctgcagagacatggggggcagtgtccgtgcctccctccctcaccacctgagctgctccacaagaaattctgagcgccactgggcaagtagagggaaccaaatgcctcaagatggagaagagtgcaaggtctaactagcagtactgtggaagagcaacacagacaagaggtgtagaattagctgggcagggtgtatgggttccttccggtgcctgcatacctgagaagaagtcattcgttgagcttagtttaggttttaaggcagttttggtgtttgaggcttatttagcacacataagtccaaggtagcatcagacagaattataaacttcatgtgacttttcaaaacaacccagtgagcccattgttagcaaatagcagtcagccgagataagcggccattctaggagcaaaggcacttgtgccaggaaaacaagaacaagcacgagcaagaagcagggcaatgcaatccacaaacacaattcatgctttacagctgtgagacaatgcttcttttgcttggacctcaggctctgcaaactgcagcacagaggagggtaagtgtgcagtggcccctagagaagagtggtcagtaatgaaattgcaccccactttacttgcccctttgtgttcctgggtcactgccaggctgtcccaatcctgcaacatgtggaaagccagtgtgttcagatggaatagtaggggatgcaacctaaagagattactagtaagattttccagaaaaagaaaaataactattttttaagcatgagcaggggtggggaggggtggggggaagaaagtttctttgtttctcattggaaagctttgcaagctattgacttattgaggaaaatcaggacaattgggtacacagctttgacttctggtgatttctgacactttcctcgaaagcctatcactccacactgagggccccaggattgactgttttacagaagctcttatgtattgaggtcctgtatgaactggacccatgtaagatggggagtggtgacaaacgttggctcaacctcaattgtgagattatggttcaaggttattttcttagagatagtgagtcttcagaaaacctttgagtaaaggcaaatgaaaggcttgtgtctaaaaacaggcttccaaaagtggaaataggacacaggaagtggagagtcggaaaacaaaacaaaacagatgagctggaatgagaagagtagagagagaagtagaaagacagggagagactctgtaaggaaagctgtgaaggaaaaggattgcagcctcttggctttattttcagttagtgcctcatacaattcacgaggtgaggctcccacacattctggcctgttctccccaattatgggggtggggaggtaaatgaactacacccagacttcttgcagctgtcacctcaatatcaggtatctgcgaggtggggagagaggtgggaggattggtaaggggctgtataattactgggaactccagccaatgtaacacatggttatgtgggcctatgtagttaggtttcactatccctattgactgtgccagaccctgaactaaatactggagtgtcgagatcaagaaggcatgattcccgcccttaggagtgcaccatcaaaggaggtgaggagtgcatctcctcacaggaggagacagatgagtaaactgaacattttgattcagtacgttttgggatacaggtaggaaccagagctgcagggccaggggaagggggcacctcccccaaaggcaaaggtcctatcctcggtcccacagaacagcttacaagactcctcctcaggtgcagctggttcggagggtacggtcgtctccagctgtctcctacatcgtctctattttctcactggctccttctagtctaggtctctccaatcctatacacatcgtttccagctctgttatgccttcaggctactggctgagactttttcttttactgctaaagcatagcatacattttcctgcatttcctccctaccctctcatttttcacccacgccttgatgtcaagttcctctctgtaccactttatcataatctccctcttgaagaagaaccaccagtgatttcctcatcactaaatccaatgatcctcattgatgttattatacagggagctgactggcaactaccacactacaagctaaaactctcccctctttcactttcccaggcctgtctgcccttgttcttcctgcagttctcctgtgcttccttcattagcaccaattccctttcccatctcataagtgggagcgtcccccagtgaacagccgcagggagcgcacctgcatccagagttccagcccttctccatgctgatgacacccaagtctttatctctaggtctgatcctttaccttatttcgagtccagaatttctaatcacgtactggtcaggttcactttcatggtcatctgtgtctctcagggttcctggcatagtgcattgcatagatatggatacaataatattaagctgaatgatgagtgaacaaatgaacggataaaatatcccagtctcctgcagaaaatcccaccttgttacctctgcctttctttcctgaccatggtttccagcctgttatcttccaagagacagacaatttattattatcttcctagaggagtctcatccccaaagcctggaaatggggctttgtattatcggtctaaagatgggtattattgtctctcacccctccattctcttttcagtgtctcattttctttcttggtgaaatagaacaaaagtgatcagcccttgtgacaagtcatattattcatggtaacattgtttcgtcttgtaagtgactgacattaggactgacatatgaactgatttataccccaacttcaacatgccctttcccacgatccttaaccccaaagcaacagtaacagctggactaacagcccttgcgatatgccaggcactgtgctgggctaagtgcttcacatgtgttatctttccgaatcttttcaaaaagcttataaggcagaaaccatttccagagaaggaaaccgaggcttagggaagttaaagtaactgaatcaaggtaagtggtagagccagggttcagggagacatgaaaacatcccactcttaacccttcaccacacagcctcttgtgtctatcggattcagttacagggggcttgagttggttcacgtctacaaataattgaacgtctgttacatagtgagcattgtgggatacaaaggtttaaaaagatcaagtccatgatctcaaggagcttacagtctagaggaagagcaccaacatgagactgacgcctgtgcagtgaaatgagacttttggatgaaagggttacatttacacaaagcacgcacagttcagtattacatgtccctgcccttgaagaagatcccagctgctagagttttgactatgcagtgtttcagatttagtttcccctcctctttgatcaggctcctctgtctttctaaagctcatactatacatataatttccattcaaattcaaaatctttccaattattgtagtgaatgcaatgttattcaaggatttttttttcctgaaagagcacctatctgacatgcatttttaattttatgtgcaatatgcaaatgtcatcactgtagttgttaaccgcagtgcaggattgcaattaactatggagctgtgcattttagttatatgctaatgctaatgagattttcataaagcaagtccaattaccagccctattttttaactgcaagagctagtgcaaagcaaaggtgttgactttctttagaataaattaccctttgtccttggctccttcatcatattcaatcatcctaaaaagtaactcctgctactttgaatattgtatcctgccttgctctccagtacaatattaatggagactgtgggcaagattgtttagaaaccaatttacactgcacaggcagtgggaaaacttcctccaaatgtaaactgctccaacagaggagcagagctttgagtactcaaagtaaacaggacctagaggagactgaagacccagacagtgagttagcaaaaataaatcacaagagagcgcatatgtggtataaccttgcactgaggaaacacaagcggtgaatgggtgtttaaactcagatttatgatcagctgtgtcactggtggaagacaaccaccttagagggatattcattcattcattcactcattcaagaaacagttgtggggacttctgtgttccagacactaaattagacactgaaggttcaaatatgaataatataggggaggagagacagactttcatattttatttctatactaattgattcttttacaaaaagaaagtgtctgtgaattacttgggcagtgaaagaatgaataagcacaatgcctgccttcagtgagcttatggtcaagtaaaaggatacaaatatgtaaaacaattttaaaaggatacaagcatgtaaaacaaaatgtgacacatgaggtatttttagaggaggacaaaatgaaggcaaaggtcagtttggagaaggaaggtgatggggagaaaaacttcttaaaagataaggagattcttgagctgaaccttgaaggtggataagtattagctagaacagggtgggaggtcagtccagaaaagaacaacctgaagaaaccacagaagtatgcaacagcccaggtgactgtaagcgatccaaggtccctggaagcacagggtgtgcagcagagccgaggtgaaaggtaaagttggaaaggagccactgagaagttttcagcaggagaataaacaatcagacgtgcctcttgggcagcaaagtggaacaagggcgaaaggtgagtgggtgggggcaagtaaatcacccacccataggaaccacttctgtgttcaactcagaccctgagacaaatgatcagattatatttcccctcaagatgtttcccgtgcccctatggaaggctatgaaacaacaaagtactctttatttttaacattttccttccagaaagaaaacatgagagacagggaaaaaacgcttgatgacgttgatatacagtttgagtgtcttttctaatctggatcaacttcgaaccaagatgaaagaagcatagaaacaaaagcacaagagaagaaaaggcaagaaaaataaggggagagaggatgacaagaatagtaccaggctgggcacaggggctcatgcctgtaatcccagcactttgggaggctgaggcgggtgggatcgcctgaggtcaggagtttgagaccagcccgcccaacatggtgaaaccccatctctatcaaaaatacaaaaattaaattagctgggcgtggtggtgcacacatgtaatctcagctacttgggaggctgaggcaggagaattgcttgaacctgggaggcggaggttgcagtgagcagagatcatgccattgcacttacagcctgggtgacaagagcgaaactccgtctcaaaaaaaaaaaaaaagtaccggctgggcgtggtggctcacgcctgtaatcccagcactttggaaggccgaggcaggtgaatcacgaggtcaggagatcgagaccatcctggctaacatggtgaaacaccgtctctactaaaaaaatacaaaaaattagccgggtgtggtggtggtcgcctgtagtcccagctacttgggaggctgaggcaggagaatggcgtgaaccgggaggcggagcttgcagtgagccaagatcgcgccactgcaccccagcctgggcgacagagcgagacaacgtctcaaaaaaaaaaaaaaaaaaggtaccaaaaatgaagtagaattaggtctgggtaatgggagtaccttttctccttttcataccaacctgcccccaaactcctgacacctctgcctgggagagaaaagccaggaattgggaaaggaaagtggaacatggaatcttctggagtcgtcagtagaagcagacgtccattaaaggcagaagtacacagagttccacttcattgtaacaaggatgaaaggttaaaagtcccagtacataggcaaatatatttagtggtggaaagttgaggagtttctatcagatgtcttctgctttaattgtgaaatatgaagtaaagttatctgccctgaggggagaggtgggaattcagacaatgaaaaagtttgagcaaatagtggggttcgtccagaattggggttttgctagataacttcagtggaaggatcaagggtcaagggaatttagaatataagtaatatgttctggataggaggaaactgaagacaaaagtggttggtggatgggcagaaaggaaagaggaggagtgatgggagcaacagagtaagctggagggagggggatgtagccggagggcagtcatctgtacttgttatctcaggggggatgtccaggtctagggtgaagctgtgagaatggaaggcggagatggggtatggaagatcactggaagatgaggaggtcagagaactgagtgctcagtggttagatgggtcagatagaaagaatatgaaacaaatgccaggcttcaacgactgaggaggagtgaacagaaaaccaaaagagaagaacatcatggaagggcagtgggggcttggcctgatgacctgggccttcaaggagcaggaatcctgaggcagatgttggtgatttttaacctcatcctttcatcatttttcttgctgatagagccttccttccccatggagatcacatgtatgagctcatgacccaaccctagccaacaggactagggggcaataagatgggggcttcggggaaagattttcctccttgttaggaaattgtaggtgaggagaaattgcactttccagttttgacattatagcaggttgaataattcccctgagagatatcaggtgctaatccctggaacctgtaaatgttaccttgtatgggaaaagggtctttgcagatatgattaagtttaggatcctgagatagggagaatatcctgaattgtccaggtgggccctaaatgcagtcacaaagtgaccttttaagaaaggggtagagggagatttgatatagacagagagaagacacacacacacacacacacacacacacacacacacacacacacacaaaggtaatgtgaaggtggagtcagagattggagtgatgtggccacaagccaaagaatgctggcagctatcagaatctggaagaggcaagaaacagattctccactagagccttcagagggagaagagccctgctaacactttgatgtcagcccagtgacacatcaaacctctggcttctagaccagtgagagaataaatttttgttgttttaagaaccaagtttgtgatatttgttacggaagccataggaaactaattcagatgtagcagtgagggatttgatgactggagtggcagcagctatcttgaaaccatgaggacacaaacctgaggataaaattaaatacaatatcctggagaagacagagtggaaaaatggaaagacctgttgaattagccacatatcactcaaccttttgacttcttatcatgtaagataataaatgtctttattgtttatggctcttctggttggatattctgttacctgcagccacaagcattctaattgatacagccctatccaaaagggtaggagagtcctggctgggaagcagcagtgggtactaaggaagaaatctgacccacttgccaactctgacaagagtgcataaaatgaaaaatgagcagctcccacttgagagaggagcagaacaggtaacttggagagagtcagaagattaagaaaatggttagggaaaagattgtagggataggggcatttgttaattatgcaacaggccttttcaaaggcagtaaaagcttaggaagaggaagataattgggaggtattctgagaaaaggtgtatgtgaatcatgacactgtactgttatgatgaaattatatagagtataggtggagtggggaataaggagagactcgcactttggacaatgaccaaaaaaaaaaaaaaaaaagggaaaatagatacaatgcttgttagatttaaccagccccagggttgccaagaaaacatttctaccaatgccaggaccaaagtagtttttgaactttaatgtttataaggttcatggagtttgttaaaaatcttaaacattcctaggccccaggaccaagatcctgactcagtagatctcagtagggtccagaaatctgcatttctaatgagtatcccaagcgattctattgcaattgatttgggaccacattttgaaacacactgtccaaaacacttgctttcacatgtttttgactaaaatctgcattaagaaatatatgttgtggcataagccacatgcacacacccacacataggcatgcacacacccacaagcacaaacgtgtgcacaaggcaggtaaaacaatctggcttaaccaaatagacatttatttttcatttacacaaaatccaaagctgatgtccctggccaggtgactccatttgggtgacattcctccaaataatggctcaggatccaggctgcttccacatgtgcctctgagatcatgtggcttcaagattgtcccggtgtcatctagtggcatacgggaagaagaaagcatggaggagcctgtgtgggagggttttaagggccatatctgaaagtggcatatatccctccagacatactctatcaacagggtctcagtcacatggccggttgtcgaggctgggagaggtagaggagcccacaggtcctggtaagcaccatcagactctccactgtagacagactgagatgtgtgtatttaaccaagaccaaagtttcacaaaataatactcctatcacatccaaatcctctgatagttttctgttttgttccatcccattcttttctagtttatttttcaaaacgtcagtcttcacaactaaattgatctcatgttcagtgaaactcactcaacacgccacagtttcaaaagcatcatcctggaggatgttgccatttggccaacggggtgggtggccccacatttttgaggggctctgttttctttgaatatacattcagcacccccacagtccagcccactcagtaagtggtcactatcattgctctcatgattgtggtggtgaaaaatacaaaggcttccccagaaatggcaattttttgcaattaacagcacgtaaaatagcctccttttggttaagactttagaactgaaacttgctagtggggcaagacgaaggaggaaaaagagctggaggacgtgtgtctacactgaaggcaggacggaatctacagagtgcctctgctgctgtgcttaccacgtggttccctttctccctgcacttggaccagacaggcaagattcaccagatgtgcaacctttgcccggctggaaaaaccagaaacccaaagccatagtagacatttccatagggatttcttacctcttttggtctggaccgacccaatgattagttactgaatttgaccctcgattgtatttctgaagctccaggttggaaatggggtgagtgggtgagaaggagcggccctggctccggctcctccccacacccaaactcttcctgtcctttccagctgtctcagacacaggcttggggaaggaagagatacacacagggaatgggaaagaggattaggaaaaggtgcggaaatgggaaaaggaagggagaagagtgggagagaggagaagggaaatcaggggacgtactccagagcaaatttttaccagatgaagagaaaaaaagaggaaaggctctttagctttcactccacctcacgcatggacttaggagaactcgactacaggactcagtttttgaaactagcttctggaaggattcagaactcactgagtttcacgaaaaatgaaaattacctgaggaaaatgctaaatgttatttaagaatcacagaataaggactgctcactttagacaggttaatgtgtggctcttggataaaaatttagaaagaggcagctgtttggaaagtccgggaggggcaccaagccagagacctggagcagctcgcagcccagccttatgctggagtaacctgagccctcagagagtccaggaggtgaggctacagtccagcattctatttttaattcacagtgtggagataagagttaaatataaagcagattaagacttcccttaaatctcctctataaaagaaaaactggaattaatctacaggagcactccatggatagctcaataccatcattttttaagaataaaattagaagcagaaaactgtgtccttatccttttgacatccaagaattattgccatgaaagtactacagcccatgaaattactttccaggttacactcattagatttagcattttcattctgtagacctgtggttttaacggaaaagaaaagaaaaaaaaatcccctcccttcatagtacaactgttcccatacactggcccattaatgggatgctaatgaatgcggaagtcattgtaaaatcacaaacgcagaactgagaagcagatttcaaacatcgataggcctagccttgttttggaaatttggatcatgagagcatgggactcaggtagagccctgcagcctgtgttttctgcacactgtagctaaagaggccctcaattacaggctcgatttttaaaaaatttttagtcatattatacaatcaccattatgggttagacattaaacagatgccaacctagctactacaggctttgtcactggaagtgttaaccacataacacggcagcagcagagcaaagagattaagagttcaggctctagagcagttggccagggtatgaacccaagccctaccaattactcactgtgtgaccttgggcaagttgcttaatctctctgtgccggtgtttccacttttgaaaagcggagataataatagtccgtgcctccagttaggattaattgagaaaatgtatgcaaagcactaaatcagttcctggcaccatagtgtgtgctcaacagcagttggtggttgttagtattttgttgttggagacgtgagagaaacgaatctgaaatggctgtgcactccggtggctgagttcaaacctgctgaggtgtctggtcttcacgacatctcaggcctcatgctgcagaggaagaggaaccagtcaccttctctgacggtcttctgtgtatctgaatctattgccatgcactgagccttgcatggtgtgtaatgccttggtttgtgtatttacatcattccagcaagtcaggatgcttttctgagcaactctctgtttgcatggtgcctttaaatacacacaagaattacaaggcaatcctctgtttgtagcctacatgaaggccagttggagagatttcaaacacccaggagattcagcaaactcattatagggtctaatataagaaggaactgtatgtatgaggagctgctaggatgcaaagatgagtaagaactgacctctgctttcaagtcaacaattagctgaggggcacagttaagacgtaggtggattgacttttgtgttatccaaacaacacaaacccattgttacagagtctccaaagatgaaacaccaaacaagacacaccttagagagcagcacagcacagattcatttcacaaatacctactgggcatcatcatttgccaggttactattctaggtgctgggatatagcagtgaacaaaagtccctgcccttgtggagctgacattctagtgggcaaaagaacaataaatagaaaagcccaagagtatgtgtatatacacacatatacacatggatagtacgtcaaggcatgctaagtgttacaaagaaaaacacagaaggggtaacaggttagggagtgacagggaaaggaggggttatatgacaagctgctaatcttgaggtaaaggaagttaaagaaagagagaaacagatgaggactaagagcatcatgagaaaattctggaacctgggtaggcaggaaggccatggtagaaggagcggggagcaggttgttctaggcatgggatttagagagagcagagaatggccagagataggaggagggccagaggagaggcaggcgcccccagggtgggcacagcacctctggggaccaggttaactaggggcctgaagccagagccatacaggccattaggtgtaactctcaagagctactgcaaactgcctggggaaaaaacataagcagtcccagtttttatttcagctggtgaacaggaaccagggccaaaggacggcaccagcctggtaacaccagacactttttctaactctcattgtcacttgtcataaagaacttccaatactgcctgctgtcacaggtgcaatctaaacaagctgaacttatagaggcagagcatagaacagtgtttgtcaggggctgggagaaatggggagttgttagtcaagaggtaaaacatctcatctatgtaggatgaaaacggtctgcagatctaatgtacagcatggtgactgcagttaataattctgcattgtatacttgaaatttgctgagagagtagatcctaagtattctcatccacacacacacaaatatggtaactttgaggtgatggacatgttagttgaccatggtaatcattacacaatgtgtatgtgtatcaaaacatcacatagcacaccttacatgtataccatttttattttaagaaaaaaaagaacctccaaatgtgcctctctccatgtgctagagaagagccttccgcagccacacattcccccttccagcctggtcacatttgggagcccctcccagctcgtgctcccccatttcaaggaaggctgcgcatcacttctccactcactctcatggtggctgggtttgaggacattatgcttggagtgatgacaccagagccacatggagaagaagcagggtggcctccaaaggaaaggaagctgggctagggcaactgtccaccacacgtggggtgtggttctatgtgtgagagttttgctgcctcttccttcagcagcgtccagaagccgtcgtctctgctgcggcctgagtgctcgcctcagcagccttccctacccctctggggtttgctgcctcaagtctttgtgatcaggagaccaaacacataggcctttaaaaaacacccggcatataagcacagaatgagagcttaaagagggccactcacaccttgggcttttgagagaccatttctaagaattgtgtctgtgtttctgtgggtagagttggctgaaattctaatgggcaccgcaacatcctctgtatgaagtaagtgtaattccttaacgcgaaatagaatggctgaacatcacgtgagtttgcccgccttgcaaactcacagaggcagtccaatccacagaatctacaagatatgctatttccatttttttcttttgtaatcaagttagcctacaagtcagtatctctgatactgagactctacaataagcagctcccatggaagcccactagctttgctcaaattgaactatttcatttcagtaaccagtacattctatgtctcattgatagaaattgctgtttggaggtttgttaatttgcttattcatttttttcaacaaatatgttgaacacataatatgtgctaagtacaatgctatgtcctagaggttcaaaggaagataaggtccttgtcaacccacaggtatatgctacatcttcttggtcttcttaagtggggtttttaaaactcccgcagaaaaactctgattctggctatgctgtaagaattttgtttttattagttctcttttaggcactgtaccttatttgaacaatcacatcattgagcacagagcaggaaaaaaaaaagagcagagaaaagttatatggagtcattctttgaaaggcctagattataaaatcagaatataaggtgaaaatcatgaataagcacaagtagctttgaaattcagttatgcaggtaccctgctggaaaccaacacacaccatgtctaggtaaatcaaactcagccatcatttcttctagctttggttaggcactagattaaacggttgacttgcatttagaggcaatattgttgataaaaacatgcctttaaaatgctaggattgcattctgtatctaataaactgggtcagaatgacagtacaacagactgatgtgtagaatattctgaaatagtaactgatgaattacgtttgcatctggtaattctaatggccctgcagctctgaaccactgagtcaaaggcatcccttccatcatatgaggatgggcctttaagccaccacctgcccttctactccctccttgtagtgaagaaaggtagctgagggttcctgagctttccaaggaggattcagacatcctgaagggaccactagaccagaagaggcctgggttgggtcaagggcagtgtgtagagtgtggacttggagcctgaatggccaaccatcagcagtgggatggtgtcacagtgcccacaaactagagaggagaagtcctacctcaactgaggtcagcacagaccagaggagagcaagcagagcgcaacagatatgttgagtctcccctgtgaagaaactcaggagggtgggaagaaacccgtagtgcccaaatgtgtacccaaagagactaaatattaaactagaagtgcctgagttattttgaaataatatttttacattgcctaccagaaatggaggcttgagagctaagttgtgttcagttatagaaaaacaaagccacatttctactcatgaatagtgctgtatgtggtaaactgctacatatcccaaacataacctcagtgactgaaatggcagaatcaccagcacaattaaatgagttctccttatgtactgagagaaatatatattgaattttcatatcttaaatgcatataggacatcatctcctcatcctcttggatcctacattcctatgccacatataacactaagctcagagaacacaatagtttgcttggataccaaaacacatagcatgtatccactaatactcacacccatccaaactcaccaaaagcacaagagaaatgagaatttttgtctcttaactttgtgcttaacaccctttgtggtttttttgtgtttgtttgtttgtttgtttgttttgttttgtttgttttgagacaaggtctcactcgtcgcccaggctggagtgcagtggcataatctcagctcactgcaacctctgcctcctgggctcatgtaatctttctaccgtagcacctaccccacccggtagctgggactacaggcgtgggccaccatgcctggtggctaattttagttttttaatagagaaagggtttcgctgtgttgccaggctaatgtcaaactcctaggctcaagcaagcgatcttcccacctcggcctctcaaagtcctgggattacaggcttgactgggttttaatgagactgaatattattctgtcatttgggtttctttctttctttcctttttttttttttgagatggagttttgctcttgttgcccaggctggagtgcaatggtgcgttctcggctcaccacaacctccacttcctgggttcaagcgattctcctgcctcagcctcccgagtagctgggattacaggcattacacaggggtaattacagggattacaccaccactcccggctaattttttgtatttttagtagagacgcggtttttccatgttggtcaggctggtctcgaactcctgacctcaggtgatctgcccgcctcggcctcccaaagtgctggcattacaggcatgagccaccacacccggccggcatttctaactctaaaaactactttagaatcatattacattctatcttgttatccaatattaaatggggcacagatgttcagtacatttttattgattaatagattaaaggactatgtttataaactggattggtcggcaggaactggggcaggttatatattaatatgttaatgtgaactaagatatggaaatttatttggataatgtgatattgacatcctacccaaccctgaaatcccatgatttctagttcaaactacctagcataacagtagtttcatctttagggataaaagactattgattctctagtggagaagcagcattctctttcaccatcctcagtctaattctccaaaatgctatttttaagaagccccagctaaaaggcaaacagcacagtgggttagatttggtgttggaaaggtagaaatagatctttccttgttgagaactactcaattcggtagaataggagacaaaaaccatttgtgctgtccagggctgagctcagtgaggctgttaaaggtagaaacagaaaacaaatctatcacggaacctcaattagctttagggggcaatatctcagagccatctccatggagaggaggccacttctctcggtgaccaggacacagtctcacagctgctcgggcctcgagggcctaaggagacaaagtgagcagaggtgagatcatgttctgtagagatcgtagtgccagccaatgtgcccctgtcctcacatgctggcaggctgcctggaagtagccagcccagctgttagatctggtggcagtctatttaacctgaccatactgggaacaacatcccagctctcctgttagtgaggcattttccaggcaaaaggtcttgtatgcatttggttcagtggttatttgcatattaggaagggctgagaaaatggcaggtagatacatccagccttccaaggaagatacacccaccctttcaaggaagaaagttggatgttttatggctagagacactatgatacttgcaaccagagtcatagctaacaactagcagtctctaaatcatatttgtcataaaattctagagtcgaaagagactttggagattgtctagttttaggaaagaatcaggagcccagagattaagaaacttgttgaaaattacacaactatttcatggcaaaaccaggacaaaaacccaaatgacctaattgctaatccagagatcttttcgtcacacccaacagctgtttgagaacatacaggacagctctcccttgctcactgctcagcctttatatccctcttcccctagtgtctgaaaagggtgtttggtggataaatatctggagggcctctgcaaattttgtttagaaggtctttgtttgctgccaatatccttccatcattttgtgacattttcctgaatatattcatttttctaatttttaagatttaaaaaataactcacgatatagaaataaaaaatagaagttctcataattttcaaactttggagatagccacattaaagattaggtgtacattcttccagatgtttatgtatataaagattttacacacacatgcaccccatatgatatgatatatgagttgttaacaatttattaagctttcactattttaaaagaagcatgctgttcattcttggtagatgggagatgagctactgaatatctattaggcatgagatttcttacccaggaagtctttgctaatgaagtctacccttcattaaccaccctgttgcaccctcattcctcactaccccactgttaacatactcttttgtttttcagccctaaagatgagaatttaagctggatctcctagaggagttgggatcaagtctatgtacttggagaatacaagagaaggacccagctgggtgtggtggctcacacctgtaatcccagcactttgggaggccgaggcgggcggattacctgaggtcatgagccccagaccagactggccaacatggcgaaacgctgtctctactaaaaatacaaaaattagcctggcatggtggtgcacacctgtaatcccacctactcaggagtctgaggcaggagaatcacttgaacccaggaggcagaggttgcagtgagccaagattgcaccactacactccagcctcggtgacagggtgagactctgtctcaaaaaaaaaaaaagagagagagagaagg

SEQ ID NO: 252 - DNA, 2559 bp, Homo sapiens
ggcatgggaggctcagcaggtctgttcccttggcatgtgggacatcttgcagtggatgcagggagggaccatgcctctagcattctctgggaagaataaaggagaagtttatcttcccacctacctcccattgcctgtttttcattggtcaaaacttgtcccactaggaattaactccttcacatttccaagtttatatcatatgactgctccaactacatgggaccccaaaccccaaacctgatgtatgtatagtgttcctgtttcatccaagcctggaaatgaggggaagagccagaacctctaggtgagtactaggtggcttggcagtgtgtgtgtgtgtgtgtgtgtgtgtgtgtgtgtgtgtggttgaggggtggagagttaaggggacttctaaggtaagtccctgattagtcccagccagttgaactgtgttgggcaggtatggtggttgagtagttgaaggtcctagaagtggacagtggccacagtgtctaaggaggcacagaagatttgtgttgagataatgattcaagagaaaagaaggacccttcatacttcagtcagagaagaattcttttggtgggctatcatgctcttgggttaaattcttttctctgtaacattatttagaaaatcgcctccctctcaacaatgaagactgagtaccactggcttacagatatttctgtatattatctgagttagtagagtttgagtatcacatttctttccttccaattctatgatttgtcatcataaagttttggcatacgcagcccagtctttggaagaggggttgagaattgtgtaatatcaggtttagcattataaagtaacatctatcatctgaagatgagactataaacaccagtctggacataatagagcatgcttagcccacttgtttggaactacaaggaaaataaggtcatacaaaagagccctctgcccttaaaaaagaattctcaattgcaaatcacttctgagtaccagtggggaaatgcagtcatttattctcaagactgaaaagagaaaggagacctttttatcactttgtgtgtgtgtgtgtgtgtgtgtgtgtgtgtgtgtgtgagagagagagagagagagacagaaagaaagagcaggagagagagagagacagagagagagaatatgtgtgtgtgttacctacctaaagctaatggtagccaattttttcctttttttcttggaatttttttcttaatctaaaacaggcttggtgctctggaaaaagaattagaattgcattcaaatagtcaggcttcaagttgcttctgcctctgtgtgaagcaaatagtaacaactcacttcgaaactcaggctcctggactgtaaatgaggataatgatactcaccctaccaacctcagggactgttctaagagcaaaatgaaatgagactgagctctgaaaatgcttaaatgcttttcaaagtagagtgatcgtgctttctgtagcatcaaaacagtcctctataaatgggcaaagtcaaggcatggactggatctgacaacagagaatggcttgagggctggaaaaagaaaaaaatgcaaatgccccaaatctctgcttcccttacagtgtggaaatcgccccataacacactgcaccaggtagggttaaattgatcccaaatgtttcaggaatttttaatgcccttcgaagagacatttccaattcttcatctgcccaaagtaatgctgctaacctactatctgtcagtttcctcagtgctttgaagatttttctaaagtcatctgacttggtttccctttgatttcaaattcctgcttattatatgtatgaccttgagcctttttaactcatctgagcctctctgtttcctcatctataaattgtgaataagaagacgttactgtaggattattagaaactttagaaataatacttttaataccagcatagtgcctgatccataggcatccaggacatgccagctaagatcattgattattgttgtcgtttttagtatcatacagtagaaagaacaacatctttgaaaccagacaatcccgcatttaaatcagctctgtcacttacgaaacgtgtaatcctgaataactgaagaaaactttttgaagttcaattttgagataatgatggatgatttcagactttgtgagaatttcagaggtatcggcagtaggttgaatggtgaaccctccaaaagatatatctatgttccaaactcagaatctgtgaatgtgacattatttgggaaaagggggttttgcagatataattaagttaagcatcctgagatgagatcatcctggattttctagatagggcctaaagccaataatgagtgtctaagacagaagaagacacaaagaagaagagacgggaatgtggtcacagaggcagagactggagcaatgcagccacaagccaaggaacacctggacccaccagaagctggaagaggaaagaagggatttctttttcttctagagccttgggagggagcatggccctgctgacaacttattttcagacttctagattc

SEQ ID NO: 253 - DNA, 826 bp, Homo sapiens
gctttgctgaggaacatggaagggggaaaacaccgactgtgataaacaccagcaggtaggctccaaatggaggccaacccaggcaactcggagagaagggagccgggatgaagcaggtgtgtgtgcgtgtgtgtgtttacacacaacagccctggcccagtgtgttctggctgcgagaacaagcaaccgcaccacgagaggagctgctctcccccccgggaggagagctccggaggcaccaattttcattaaacctaggagtacacacaggggcaggaggccaaaacagtcctcgaaactgaggcttttaaaaacatctgttggcagcgttgagatcctagaagagagagagagacggagagagagagagagagagagagagagagagagagagagagagagctcagagtccagcactttcatttccagactgtgagtcataaaaggagtacgtaaatccctatcgccagaatacgctgacccaagtctgggtttatgaacacctgaagtacatttcatgagaattagctttaaatatcaacctgatcacaaagcttgaaaggttttctcccatctcaggatgactggagtccgctggaacctggaatggagttttctgacagcaaaggattacaggagcgtaacagaaattatggagatttccccgctaggcataaggatgcgatcactgtaggcacctgtgggcccaagcaggttacccaccaatatccctttaaacaccaaattatggactattaggccactgcttcaaggcttctacaaatgtgaaaccttgacaaattcccaaataaaagccataaaacca

SEQ ID NO: 254 - DNA, 39 bp, Homo sapiens
ttttcatgcttctaggataagggaaattggaaatgctac

SEQ ID NO: 255 - DNA, 91324 bp, Homo sapiens
accagcagcacccagtggccagcagcgtactctttcacctcttcttgggtgactttgtggaatgctccaatgtgacatctccctgtgaacgcctttcctgacaccctaaaaagtgtcaggaatttccagcaagttccagagagcaggtttccagcaagtttggtcagtatgacaccacagcgatatctctgccattcactgaacttggattcttccttcttcagtgaggtatggatttcaaccctggattgggaagtggctggggacccttccctgggcactgtatcccagccctggggacagtggctgcttcatattcccgtatccattagcattctcttctttttttttttttcctttccaacttttattttaggttcaggggtacatgcgcaggtttgttacatgggtaaactatatgtgatgggggtttggtgtacagattatttcatcacccagataataagcatagtacttgacaagtagtttttcaatcctcaccctcctctcaccctccaccctcaagtaggcccaggtatttagtttccttctttctgtccatgtgtactcaatgtttagcttccacttataagtgagaacgtgaagtatttattttctgttcttgcattaaattgcttaggatactggcctctagctctattcatgttgctgaaaaggacaagatttcactgttttttatggctgcgtagtattctgtggtatataatatgtaccacatgctcattatccagtccaccattgataggcatctaagtggattccatgtctttgctattgtgaatagtgctgtgatcaacatatgcatgcatgtctttatgggaaaattatttatgttcctttgtgtatatacccagtaatgggattgctggcagttctgtcttaaattctctgagaaatctccagactgctttccacagtggctgaactaatttacgttcccaacagcagtgtgtatgcattccctttgctccacaacctcaccagcatctgttattttttgactttctaataatagccattctgactggtgtgagatggtatctcattgtggttttgatttgcatttctgtaatgattagtgatattgagctttttttcataggcttgttggctgcatgtatgtcttctttggagaaatgtctgttcacgtcatttgcccattttttaatggggttgtttgttttttgcttgttaatttatttaagttccttatagattctggatagtagacctttggtgtatggtttgcaaatattttctcccattctgtaggttgtctgtttactctgttgataattcccttttttgtgcagaagctctttagtttaattagatcccacttgtcaatatttgtttttgttgcaattgcttttgaagtctttgtcatgaaatttttgccagggcctatgtccagagggtacttgctaggttttcttctagggttttcatagttttaggttttacatttaagtatgtaatccatcttaatttgtgtatatggtgtaaggaaggggtccagtttccattttctacatatggccagccagttatcctagcaccatttataaaatagggcatcctttccccattgcttgttttcattgactttgttgattatcagttgtaggtttctggctttatttcggagttctctaacctgttccattggtctatgtgtctgtttttgtatcagtatcatactgttttggttactgtggccttgtagtaaaatttgaagttaggtagtgtgatacctccagctttatactttttccttaggatttctttggctatttgggcacttttctggttccatatgaattttagaatagtttttctaattctgtaaaaaatgtcattggtagcttgataggaatggcattgaacatataaatttctttggacagtatggctgttttaacaatattgattcttcctatccatgagcatggaatatttttccatttctttgtgtcatctctgatttctttcagcagtattttgtaattcttgttgtagggatcttttacctccctgtttagctctattgctaggtacttctttgtgttgcttttgtgaatggggttgcattttaaaaaataatttaaaaaattttgaggggtacatattaggtgtacatatttatgaggtacatgagatgttttggtacaggcatgtaacacataataatcatgtcatacaaaattggctatttatcccctcaagtatttatcctttgtattactcttttagttattttaaaataactaaaattatgcttttagttattttaaaatgtacaattaaattattgttgactatagtgcccctgttatgctgtcaaatactaggtcttactctttctttctattttattttgtacccattaaccaaccccacttcttccctgccctcccactacccttcccagcctctggtaactatcctgttctctatctctgtgagttcaattgttttgatttttagatttcacaaataagtgagaacatgtgatgtttttctttatctgcctagcttatttcacttaacatgatgacagccagttccatccatgtcgtcgcaagtaacagaatctcattcttttttttgtggctgaatagtactccattgtgtataagtatgacattttctttatccattcttctattgatgaacacttaggttgcttctaatgttggctgttgttaacagtgatacaacaaacatggtagtgcagatatctcttcagtatactgatttttttcttttggtacatacccagaagtgggattgctggatcacataatagctctattttagtctttcaaggaacctccaaactgttttccatagcggttgtactaatttacatttccaccaacagtatatgagggttcccttttctccatatcctcaccagcatttgtttttggctgacttttggataaaagccattttaactggagtgagatgatatcttgtaattttgatttgcatttctctgatgatcagtagcattgaccactttttcatatgcctgtttgccatttgcatgtcttcttttgagaaatgtctattaaaatattttgcccatttttaaatcggattattagatttttttcctatagggttgtttgagctctttatatagtctgcttattaatcccttgacagatgggtgttgcaaatattttctcccattctgtgggttgtctcttcactttgttgattgtttcctttgctgtgcagaagctttttaacttgatgtgatcccatttgtccatttttttctttggttgcctgtgcttgtggggtacgactcaagaaatttttgcccagaccaatgttctggagagtttcctcaatattttcttgtagcaatttcataatttgaggtcttagattgaagtctttattttattttattattaaactttaagttttagggtacatgtgcacaatgtgcaggtttgttacatatgtatgcatgtgccatgttggtgtgctgcacccattaactcgtcatttaacgttaggtatatctcctaatgctatccctcccccctcccccgaccccacaacaggccctggtgtgtgatgttccccttcctgtgtccgtgtgttctcattgttcaattcccacctatgagtgagaacatgcagtgtttggttttttgtccttgcgatagtttcctgagaatgatggtttccagcttcatccatgtccctacaaaggacatgaactcatcagtttttatggctgcatagtattccatggtgtatatgtgccacattttcttaatctagtctatcattttggacatttgggttggttccaagtccgctattgtgaatagtgccgcaataaacatacatgtgcatgtgtctttatagcagcatgatttataatcctttgggtatatacccagtaatgggatggctgggtcaaatggtatttctagttctagatccctgaggaattgccacattgacttccacaatggttgaactagtttacagtcccaccaacagtgtaaaagtgttcctatttctccacatcctctccagtacctgttgttccctgactttttaatgattgccattctaactggtgtgagatggtatctcattgtggtttttatttgcatttctctgatgaccagtgatgatgggcattttttcatgtgtcttttggctgcataaatgtcttcttttgagaagtgtctgttcatatcctttgcccactttttgatggggttgtttgtttttttcttgtaagtttgtttgagttctttgtagattctggatattagccctttgtcagatgagtagaatgcaaaaattttctcccattctgtaggttgcctgttcactctgagggtagtttcttttgctgtgcagaagctctttagtttaattagatcccatttatcaattttggcttttgttgccattgcttttggtgttttagtcatgaagtccttgcccatgcctatgtcctgaatggtattgcctaggttttcttctagggtttttatggttttagatctaacatttaagtctttaatccatcttgaattaatttttgtatacggtgtaaggaagggatccagtttcagctttctacatatggctagccagttttcccagcaccatttattaaatagggaatctttcccccatttcttgtttttgtcagctttgtcaaagatcagatagttgtagatatgtggcattatttctgagggctctgttctgttgcattggtctatatctctgttttggtaccagtaccatgctgttttggttactgtagccttgtagtatagtttgaagtcaggtagtgtgatgcctccagctgtgttcttttggcttaggattcacttggcaatgcaggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatactcttttacttcactgagcactggtttgtagttctccttgaagaggtccttcacatcccttgtaagttggattcctaggtattttattctctttgaagaaattgtgaatgggaattcactcatgatttggctctctgtttgtctgttattggtgtataagaatggttgtgatttttgtacattgattttgtatcctgagactttgctgaagttgcttatcaccttaaggagattttgggctgagacgatggggttttctagatatacaatcatgtcatctgcaaacagggacaatttgacttcctcttttcctaactgaataccctttatttccttctcctgcctgattgccctggccagaacttccaacactatgttgaatgggagtggtgaaagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaattttgtcaaaggccttttctgcatctattgagacaatcatgtggtttttgtctttggttctgtttatatgctggattacatttattgatgtgcatatgttgaaccagccttgcatcccagggatgaagcccacttgatcatggtggataagctttttgatttgctgctggatttggtttgccagtattttattgaggatttttgcatcgatgttcatcaaggatattggtctaaaattctctttttttgttgtgtctctgccaggctttgatatcaggatgatgctggcctcataaaatgagttagggatgattccctctctttctattgattggaatagtttcagaaagaatggtaccagctcctccttgtacctccggtagaattcggctgtgaatccatctggtcctggactttttttggttggtaagctatgaattattgcctcaatttcagagcctgttattggtctatcagagattcagcttcttcctggtttagtcttgggagggtgtatgtgtcaaggaatttatccatttcttcttgattttctagtttatttgtgtagaggtgtttatagtattctctgatggtagtttgtatttctgtgggatcggtggtgatatcccctttatcattttttattgcgtctatttgatgcttctctcttttcttctttattagtcttgctagcggtctatgaattttgtcaatcttttcataaaaccagctcctggattcattgattttttgaagggttttttgtgtctctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttaatgctataaatttccctctacacactgctttgaatgtgtcccaaagattctggtatgttgtgtctttgttgtcgttggtttcaaagaacatctttatttctgccttcatttcgttatgtacccagtagtcattcaggagcaagttgttcagtttccatgtagttgagtggttttgagtgagtttcttaatcctgagttctagtttgattgcactgtggtctgagagacagtttattataatttctgttgttttacatttgctgaggagtactttacttccaactatatggtcaattttggaataggtgtggtgtggtgctgaaaagaatgtatattctgttgatttggggtggagaattctgtagatgtctattaggccgcttggtgcagagctgagttcagttcctggatatccttgttaactttctgtctcgttgatctgtctaatgttgacagtggggtgttaaagtctcccattattattgtgtgggagtctaagtctctttgtaggtctctgaggacttgttttatgaatctgggtgctcctgtattgggtgcatatatatttaggatagttagctcttcttgttgcattgatccctttaccgttatgtaacggccttgtctcttttgatctttgttggtttaaagtctgttttatcagagactaggattgcaacccctgccttttttttgttttccttttgcttggtagatcttcctccatccttttattttgagcctatgtgtgtctctgcatgtgagatgggtttcctgaatatagcacactaatgggtcttgactcttcatccaatgtgccagtctgtgtcttttaattagagcatttagcccatttacagttaaggttaatattgttatgtgtgaatttgatcctgtcattatgatgttagctggttattttgctcattagttgatgcagtttcttcctagcctcgatggtctttacaatttggcatgtttttacagtggctggtaccggttgttcctttccatgtttagtgcttccttcaggagctcttttagggcaggcctggtggtgacaaaatctctcagcatttgcttttctgtaaagtatttcatttctccttcacttatgaagcttagtttggctggatatgaaattctgggttgaaaattcttttctttaagaatgttgaatattggcccccactctcttctggcttgtagagtttctgccgagagatccactgttagtctgatgggcttccctttgtgggtaacctggcgtttctctctggctgcccttagcattttttccttcatttcaactttggtgaatctgacaattatgtgtcttggagttgctcttctcgaggagtatctttttggcattctctgtatttcctcaatttgaatgttggcctgccttgctagattggggaagttctcctggataatatcctgcagaatgttttccaacttgtttccattctccctgtcagtttcaggtacaccaatcagacgtagagttggtcttttcccatagtcccatatttcttggaggctttgttcgtttctttttattcttttttctctaaacttctcttctcacttcatttcattcatttgatctttcatcactgataccctttcttccagttgatcaaatcggctactgaggcttgtacattcgtcacgtagttctcatgccatggttttcagctccatcagatcctttaaggacttctctgcattggttattctagttagccattcgtctaatcttttttcaaggtttttaacttctttgccatgggttctaacttcctcctttagctcggagtagtttgatcgcgtgaagccttcttctctcaactcgtcaaagtcattctctgtccagctttgttccattgctggtgaggagctgcatttgtttggaggaggagaggcgctctgctttttagaatttccagtttttctgctctgttttttcccatctttgtggttttagctaccttttgtctttgatgatggtgacatacagatggggttttggtgtggatgtcctttcactttgttagttttccttctaacagtcaggaccctcagctgcaggtctgttggagtttgctggaggtccactccagaccctgtttgcctgggtatcagcagcggaggctgcagaacagtggatgttggtgaacagcaaatgttgctgcctgatcattcctctggaagttttgtctcagaggagtacctggccgtgtgaggtgtcagtctgcccctactggggggtgcctcccagttaggctactcgggggtcagggacccacttgaggaggcagtctgtccgttctcagatctcaagctgtgtgctgggagagccactactctcttcaaagctgtcagacagggacatttaagtctgcagaggtttctgctgccttttgtttggctatgcccttcccccagaggtggagtctacagaggcaggcaggcctccttgagctgcagtgggctccacccagtttgagcttcccagccgctttgtttacctactgaagcctcggcaatggtgggcacccctcccccagcctcgctgctgccttgcagtttgatctcagactgctgtgctagcaatgagcgaggctctgtcggcataggatcctccgagccaggcatgggatacaatctcctggtgtgccgtttgctaaggcccttggaaaagtgcagtattagggtgggagtgacccgattttccaggtgccatctgtcaccccttgtcttggctaggaaagggaattccctgaccccttgtgcttcccaggtgaggccatgcctcgctctgctttggctcacgctcggtgtgctgcacccactgtcctacacccactgtctgacaatccccagtgagatgaaccgggtacctcagttggaaatgcagaaatcattcatcttatgcgtcactcacactgggagctgtagactggagctgctcctattcggccatcttggctcagatttaagtctttaatccatttttatttgatttttgtataaggcgagaaatagggatcaagtttcattcttctgcgtatggatatctagttttcctggcatcatttatcaaagagactgtcttttcccccaatatgtgttcctggcacctttgttgaaactgagttcattgtaggtgtgtggatttgtttgtgggttctgtattggtctatgtgtctgtctttatgccagtaccacactgttttggttactatagctctagctctgtagtataatttaaagtcaggtaatgtgattcctccagctttgttttttgtttgtttgtttgtttgtttttttgtttgttcagaatagctttggctattctgggtcttttgtgattccatataaattttatgattttttttctacttctgtgaagatttcattggtattttgatagggattgcattgaatctgtaggttgctcaaggtagtatggacattttagcaaaattgttttttccaatccatgaacatggaatatctttgcatttttctgtgtccatttcttccatcattgttttataattttcattgtagaggtctttcatttctttggttaattcctaggtatttggaattgcatttgtgatttggatctcagcttgaatgttattggtatagagaaacgctactgatttttgtacattgtttttgtatcttgaagttttactgaagttgtttaccagatataggaccttttgggcagagactatggggttttctgggtataaaataatatcatctgtgaagagagatagtttgacttcctctattcctacttggatgccttttaattctttctcttgcctgattgctcagctaggacttccagtatgcatttaatatgagtggtgagagtgggcttccttgtcttgttctggttcttaaggggaatgcattcagcttttgcccattcagtatgatgttggctgtgggtttgtcatagatggctcttatattttatgcataatttgttgagggtttttaacatgaagagatgttgaattttattgaaagccttttctttgtctattgagatgatgatgtggtttttatttttccttctgtttatgttatgaatcacatttattgatttgtgtatgttgaatcaaccttgcatcctaggaataaagcctactttctcatgatggattagctttttgatgtgctgctggattcggtttgatagtatttagttgaggatttttgcatctgtgttcatcaaagatattggcctgatgttttgtgtctgtgtgtgtctgctgggttttggtatcagaatggtgctggcctcatagagtgagttagggaggagtccttttcctcaatttttgggaatagtttcagtagaattggtactggctcttcattatacatctggtagaattctgctgtgtagccatatggctcagggctttttctgattggtaggttttttatgaatgattcaattttggaactcattattggtctgttcaaggttttaatttcttcctggttcaatcttgggaggttgtatgttttcagtaatttattcatttcttctaggtttctggtatgtgtgtgtagaggtgttcataatagtctctgaggagtttttctatttctgtggggtcagtgctaattccccctttgtcctttctgattgtccttttttgaatcttctctctttttttctatataattctaactagtagtctatcaatcttatttattatttcaaaaaaccaactttaggttttgttgatcttttgcatgttttttcacatctcaattttattcagtttggctctgattttggttatttgttttcttctgttagctttggggttttttttttcttgtttttctgattcctctaggtgtgacgttagattgttaatttgagagctttctaactttctgatgtgggcatttagcactataaactatcctcttaacacttcttcatttgtgtcccagagattctagtatattgtatctttgttttcataagtttcaaataatttttttatttctgccttaatttcactgtttacccaaaagtcatttatgagacagttgtttagttttcatataattgtattgttttgagagatcttattagtattgatttctgtttttattttgctgtcttccaaaggcttggttggtatgattttgatttttctgaatgtgttatgaattgttttatggccaagcatgtggttgattttagagtatgtgccatgtgcagatgagaagaatgtatattttgttgttgttggatggagtgttttgtagatgtctgttaggtctatttggtcatattgtgtttaggaatatgtaacaaatatgtaacaaatatctttgttagttttctaccttgatgttctgtctattactgtcagtggggtactgtattagtctgttctcacactgctataaagaactacctgagactggataatttatggagaaaagaggttaaattgactcacagtttgcaggctgtacaggaagcatgactgggagggctcaggaatcttataatcatggcaaaggcaaaggggaagcaagcacatcttaccatggcagagcaggagagagagaaggggaaagtgctacacactttcaaacaaccaggtatcttgataactcactcactatcatgagaatagcaagggggaagtccacccctcatgatacaatcacctcccaccaggcccctccttcaacactattaattacaatttgatatgagatttgggtgaggacacagtgtcaaaccatatcattccacccctggcccctcccaaatcccatttccttctcatatttcaaagcacaattatgctttcccaacagtcctgcaaagtcataactaattccagcattaactcaaaagtccaagtccaaagtctcatctgagacaaggcaagtcccttctgcctctgagcctttaaaatcaaaagcaagttagttactttcaagatataatgggggtacaggaatttggtaaatagaccttttctaagagggagaaatcagccaaaacaagggggctacaggccccatacaagtctgaaacccagcagggcagtcattaaatctcaaagctttaaaataatctcctttgactctatgtctcacatccaggccacattgatgcaaggggtagactcccaaggccatggacagttctgcccctgtggctctgcagttcccacagctgttttcatgggctggcattgagtgcctgcagcttttctgggcatgtggtgccagctgttggtgggcctactatcctgaggtctggaggatggtggccatcttctcacagctccattaggcagagccccagtggtgactctgtgtgggagcttcaaccccacgttttccgtctgcactgccctagttgaggttctccatgagggctctacaccacagcagacttctgcctggacatccaggcatttccatacatcctctaaaatctaggtagagactccaaaacctcaactcttagcttctgcacacctgcaggctccgcaccacatggaagccatcaaggctttgagctttcaccctctgaagcaatggcccgagctgtacattggcccattttagccatggctgaagctggagtggctcagatgcagggcgccatgttctgaggctgcacagagcagcaaggccctgggcctggcccatgaaacatttttttcctcctaggtcttcaggcctgtgataagaggggctgccatgaaggtctctgaaatgccctggagacattttctccgtcgtcttggcagttaacattcagctcctctttacatatgcaaatttctgcagccttgaattcctcttcagaaaatgggtttttctttttatattgcatggttgggctgcaaattttccaaacttttttttttttttttttttttggagacagagtctcactctgttgcccaggatggagggcagtggtgtgatcttggctcactgtaatttccacctcctatattcaagtgattctcatgcttcagcctcctgagtagctgggattacaggcatgcactaacacacctggctaatttttgtatttttagtagagatggagttttgccatgttggccaggctggactcgaactcctggcctcaagtgatctgctggccttagcctcccaaagtgctgggattacaggcataagtcaccacacccagcccgaattttccaaacttttatgcttgcttcccttttaaatataagctctagttttaggtcatttctttgtttatgcaaataagcataggcttttagaagcagccaggtcatatctggaacactttcctgcttagaaatttcttccgtcagaagaaatttcgtctctctcaagtccaaagttccacagatctctagggcaggggcacaatgccactagtctttttgctaaagcatagcaagagtgaaaaataattattccagtttctagtaaattcctcatctccatcagagaccacctcaggctggacttcactgtccatatcactatcagcatttaggtcacaactattcagcaagtctctagaaagttccaaactttccctcatcttcctgtcttctgagccctccaaactattccaacctctgcccattacccagttccaaagtcacttccacattttcaggtctctttatagcaatgccccacttctctggtaccaatggtggaatggctttttgaagtcacaatcacaacgccaactaggtgtgaaaatactttacaaggtttgggcaaagttctccagaaggctgtgtatgctttgaatcagcatccaatatatggtactgtttttcccatagcgggattcatgggttcaggaatcaaggggtggaagtggaagtggcagcattcaccatcacccctagtgacccactagcaaaatttttacattcttttcccacaacattatcttctactggcctagaggtcttagttccagaggaaggaatgctgccaccaggagacacagcaatgattccatttaaccggaagttaagattgccacctggccactctggcctcctcttgcctctaagtcaacaggctaagaagggagttacagtgttggctgaagtgattgacccagactatcaagatgaaataagactactactccacaatggaagtaaggaaaagtatgtctggaatacaggagaccccttagggcgtctcttagtattaccatgccctgtgattaaggtcaatggaaactacaacaacccaattcaggcaggactacaactggccagaacccctcaggaatgaaagttttggtcactctaccaggtaaaaaaccgtgaccagccaaggtgcttgctgaaggcaaagggaatacagaatgggtagtagaagaaggtagttatgaataccagctatgaccacatgaccaggtacagaaatgaggattgtaattgtcatgactatttcctccttattttgttataaatatgtttgtgcatacatacacctgtactgagaaagtgtcttcattttatttcccttctttttcctttatcacgtaacgtaagatttattgacttcatatcagcatttaagtgttgttaactttatttaatagcatttaggttaaggattagtgtgcttcttgttgtatgaaggatagttgtattatgttaggcataattatgacctattattttctttatttggagattaagtgtgatttcaggagatgtgtatgagtgccaagttgacaaggagttgacttgtgatagtcaatatgaggtgacaacctgattggattgaagaatgcctagatagctggtaaagtattgtttctgggtgtgtaagttaggatgttgcctgaggagattgacatttgagtcagtggactggaagaggaagacccaccctgaatgttcaatgggcaccatccaattggcgccagtgcagctagaacaaaagcaggaggaagaaggtgggataagacggcttgctgtgtcttctggctttcatttctttcctgtggtggatacttccttttgtttctcctgcccttggccatcagactccaagttcttcagccttttgactcttggacttctgccagtgtttgacgaggggctcttgggccttcaaccacagactgaaggctgcactgttgactttcttgcttttgaggcttttggactcagactgagccactactggcctctatcttcctcaacttgcatatggcctattgtgggactttgccttgtgatagtgtgagccaattctccctaataaacttcctttcatatatacgtatatcctgttagttctgtccctctggagaaccctgactaatacaggtactgatgtcttccgctattattttgtggttgtctaagtatcttcctaggtctcttaaaatttgttttatgaatctgggttctccagtattgggtgcagatatacttaggatagttaagtcttttcgaattgaacccttaatcattatgtaatacctttctttgtcctttttgtcatttgtcagtttaaagactattttgtctgaaattagaatggcaacccctgctcttttttgttttccatttgcttgcttgattttctttttccagtcctttactttgagcctaaggatatcattgtatgtgagttggatctcttgaaggcagcatacagttgggtcttacccctttagattcttaattcttcaccttttaaatggggtgtttagaccatttatgttcaagtttaatattgatatgtacagatttgattctatcattgtggtgttagttggttgttatgcagacttgattgtatagttgctttatggtgtcaattgtctatgtactgaagtgtgtttttgtgatggctagtaacagttttttgtttccatatttagcatgcccttaaggacctcttgtaaggcaggtctggtggtaatgcattcccttagcatttgcttgtctgaaaaggattttttttttttttcatttatgaagcttagcttcactgggtatgaaattcttggttggaatttttttcttttgagaatactaaatataagcacccagtctcttctggcttgtaggatttctgctgaaagacccactgttagcctgatagggtcccctatgtaggtgacctatccgttctctctaactgcctttaatattttttcttttactttgaccttgggaatctgatgactatgagtcttggggatggtcatcttatatagtatctcacagaagttctctgaatttcctgaatttgaatgtttacctctctagtaatgttgggggagttttcatggacaatatcctcaaatatgtcttccaagttgcttgttctccctccctctttttcagggataccagtgagtcataggtttagtctctttacataatatcatatttctcagaggtttgtttattttttttctttattttgtctgactaaattttttttaagaaccagtcttcgagctctgagattctttcctcagcttggtctattccgctgttaatacttttgatttattatgaaattattgaaatgagtatttcagatctatcagatcagtttggttctttcttaaaatgtctattttgtcttttagatctcttatcattttattggactccttggattgggttttggctttctcctgaatcttgatgctcttctttgctatcctgattctgaattccttgtctgtcattttagtcatttcagtatggttaaaaacaattgctggggagcaagtgaagtcatatggaagtaagaagacactttggctttttgagtcgccagagttcttgcactggttctttcttatctatatgggctgatgttcctttaatctttgaagttactgccctttggatgggttttttttgctttctttgatgcccttgtggtataaattggattcagttaactggcttcattgctgaaagatttcagggggctacagctcagctcagcacagctgggctgtgtgctgtaatcctaggcagctggtagcaggcccatggctttattctctggtacttcaaggttaagcacctcctgcactggaggggctgaggtgttcccggcctgctggcaacaacgatctgatgggggatgctggcaaaactgcttctttggggtatggcagcagggtccttgcatgtatgtgtgcactggtgggagcagggcagcagagtccgtgcacacacatgcttgtgccagtagcagcaaggcagtggagtgcgcatgcacatgcacgggcagggcctgtctcacagggttcttgtgagggttaagggagataatacatataaattatttgaaaccgtacctggaacataataagtattcaataaatattatctgttgttataagttaatctgagtggatctgagattgaatttggttggagggccacaaagacaaatgtagtgcctgacaggagcatatgccacagtttacttagccattcctgcgtggcagacattttgttgtttttgatgttttactgtaataaacaatgctattattaacatatttgtgtgcaaaacccatgtacttgggaactttatttatagtggggaatggcaagtcatttatctttaaggaggtgcttcataaaccaacataggttttggcctcacccaatacagcaagtagaattattataaagtatagaataaatcttgttgaggatcttagtgactcaaagtttgccaacttgtcaagaacctctttctaactgcttcttaacatgtgacaaagcaaagtttttcttttgagaaaataataatattcaatacacagtaagtaatcttatcatagtttttaggatgtcctttggctctaagttaggcacattgaaaatgcccattctgagttagttagttaattaagttaatacttattcaaatgtcaaatggtttagaaattaaacaattttgggatgggacttcaggaatgacttaatagttatatgaccttgggccagttattttaacctctgtgaattaagcaattattttggcctctctcagactcagtttcctcataagtataataaaaataataatgcttatgttaatttttatgcaacaattatatattgagtttctattacatgacaggtacttttctaggtgcttgggatgcatcagtgaaaaaaatctccctgttccaaaggaccttacattctagtggtagcaaggacagatgataaatgataaacataatgcttaaataaattatatagcatattagaaaatggtaaatgcaatggaaaatggaaaacacagtgttggataagaaggatcaggtatgcatggaaggatcaatatttttaaaagtgcagttagggtaggtctcactggggtaatatttgaacaaaaatttgaaagaggtaaggcagtcagccatgcagctatgtggggagaggtattccaggtagagagaagcaagtggaaggcccttaggtgggagcatgacaggcatattttaggaatagtaaggacagtgtggctgaagcagagtgaatgagggggaagatggttggagacaaagtcagtgaggtaacaagtcccagatcatgttggaccttctaggcattgtcagagcttcagattttgctctgggtgaaatggaaagtcatggaggattctgaacagaggaacagttgaacttatgttttatcagaatcattctgactcttgagtgaggataaactctgggggtgcagctgatattgtcactccttctccttcctgttccccttcccatggaggatacagcctggcagctgaaaatgtgaggcagcgaaggggttggggcagccatgcagaggcataggctggggttggggagctgcaggctgtgggtcagaagctgagggggtggtgtggaggtggtaggtggaagacacagccagcatggcgggtggtagagtggggagagggagttggtcacactgagcaaattagtaaattgatggtgaatgtaagaataatgggagccaagtttttcactgctggagaaggaatttataaacagaaatgaggaaggctagaaggaactctgaagttggacaggaattggaggtatcagtatgaacatatgattgtctgtctagctagctttgtaattatagatgtttaagtgtgtgccatatatatacacatcatgtccaagctctgttcaccgggagggcttagtagcaataacaccttagtaacaattagtacaatgagcacccagacattggtttctaaaaaccatctttcactggaagataccaaggctccttggagtgatggccaatggctgattccaggttggttggggtgggagtggggagacttggaaagtgtaagatgagcctgcaacgtcttgtactggacaataaggaaaggctcagtgaatggtgggaacatttcaaaaggacacaggggctcctattggtcaaatcagggagaatttttgcattaaagaataataatggattacaactcattgaataaaataggaatctgtgaatccattccgatgcgaatgaataaatgaatgaaaagggtaagcttgactttactataaaatgccaactaataaatgtataaacaataatgtttggcaactttcacagatgtagtttgatttgggctaaagtcatcgatgaagtctcacagaggatggatgctaaggctgaaaggtgaaggtttcatgaggaacaggatattctgacatattctgagaataccttcccctaacatataaatcaattacaaagaaaaaatggtaaatttaagtggagaaagctggcagacatcaacatgaccaggagaccaaggtgggataggttgacattgtatcacttctgatgtgatgccctgagaagagaatgtcattgtttctgtggaattcttgccctggatgaagtgcctgagtctgatcgtaaggaaccatcatcctacagggggtgatcctaccgaatgtaacacttcctactgtgccaagtgcatggaagatggggaaagactgagacacttccagatcaaaggattctgaagagatataacagctaactgtgatgtgttcgtgaaaaactcctgaaccacagagggaaaagagacattttagggaaattagcaacagctgaatgggatttgatggtagtgtatcgatgttaatttcctgattcaaagagttgtatgctgattatataggacagtgttgttgcttttggaaaatccacactgaagagtacttttggggtgacagagcttaccctcaaaagcttctgattatgtagttaaaattatttttaaatacttttatttctaaaagaaggctattggaagtgagagataatgatgatttagatcagggaggtgatgtggcagtggtgggaaatggtcagactcaggatatattttgaagatagaaccaatagaacttcctgatgaattggatataggttatgaaagaaaaataggggcaagaatgattccaaggttttggcctgagcatctggaatgataagtaaactgtgggtgagacaggtttttggagggaatatcaagagtaccatattggatgagttgagtctgagacactctattagacatcctcctaattaagatgtcagggaggcagttagagacaagaattggaagttcaggaagggatttgtgctggagatagaaatttgggagttatcagaaagcagatggtatttaaagtcatgaggggatgagatcaccagaagaggaaatgtagagaagagggcattctcaggactgcttggcaggggtattttcagcctaggtaaactcactgaaaaattactgaaaaatgtccaactatgtaaaaatccacggctaaagtcttcaaagaggtaacagtttgacatatgcaaagaggattaacaacataaagaacaagattattataaacattaacatttacattgtgtttactatgtgtcaggcacaatgttgctttatatagattatcacatttaatcttcatctcaatcttgtgagaggggtaatatcatttctagttttcatgtgaggaaactgaagctcaaagaatttaaataatgtgttaaaggtctcacagctagtaaatagtgagcctgggattcatatccttgtgatctgcctacactaccttccattctaatggctgcactatcctgcctcaagtactggacgaggacagaaagaagcctgtcatggggctctagacccctcttgactgcccaaaacaaccacatcaaaccaacattttcacacacaccacaccacacacacacacacacgtgcacacacaatcaagagctgaagccttagaagatataagaacattccatctttcaggctgactgcccctcacttacggccatgtcagctccctgagagaggtcttagaaattttagtgtgttggaggaaggacttacagtggagtaaacccatgtttccaaggaccatggtccaacaataggcagtggaaagagtatcccaggctccaaagagcaacatcagcgtctgggttatgaacacgaccaaccctgtgtttttaagagctccatctttcctgaaatatccttcttttggcttgctgttatttgccacttttataagctactgagccacatcactggtgtgaacagtttcaaagcttacatatttcttcttgtaatcagtttagtcgatcttgtaactataaagagtgagatggtaaatcctgagctctcattctgagtcagaatttatgataagaacaacgtgcttgtgcccaaacagaaccatgcatgtatggtaatatggcacttgaaatttatgtacttccttttatccaaggaacagaaagtgcttctgtaaaatggatttagagccaactgtctacagcaggcaatgggaacagttcaaaaaaggactgccgagagaatcatttaatttatgcaaggccagggttcacactaaacaaccatgtgccccaatttgtttcacagaaatggttccaggagaccactgccatttcaacccctgctcaacagggatgaattcaactgcatctttgcccaccagttgtatatgaagacattctttcatccctgcggtttagtgctggttgctgcacaggactagcccctggtattagctgaggagatcaccagcagaatgggtcccatcattcctttccactgactaactggttggctcttcttcttagtaagggagagcctttatgattaactgtgctagcatgaaaaaactctagtcttgtaggtaagcccactataatttataaccccactataaaatattatggcttctctctatcacacacttcaaaatgcacatgctacagtaggtccttgtattagttacctatcgctgcataacaaattatccaaaacttagtgcgttaaaaggtttattatgtcccagtgtctgtgggtcaggaatcctgacatggcttgactgagtcttctgcttcaaggcctctctcaagatcttacccagggctgtagtcatctccaggctagactaggggaggacttgcttccaatcatgaggtatttggcatgattcaattctttgagggctgtgagactaaggccccagtttctcacaggctgttggttggaggtctccttcagtcccaagagagagcaccagcacgaatgaagtcacagtcttttgtaacctaatcacagaagtgacatctcatcacctttgccatattctatttgtagaagcacgtcaccagttcacatttacgggcaggggcttacccagggcatgaaaaccagaaggcaggaatcattgggagccactttagaagctgcctgccaccatccgatgtatattgtcacacttgtccttataatgatcctccaatgcagcgttagtcctctcatttcacagatggggcaagttctcagactttagtacttgcacctactgacacatttatctttagtgactcatcgtgttcattcatgtatgcatttattccacgactatgatgtgaaagtacaaaatattaggtatgctactgtgctaggtgccagtaagttttattcttggtaaactataggtgtatacagcatcctagtagttcttcaatgagtatttactgagaggaagaactgttcattatatatgtatatatatatatgtatatagtagtgcctaatttattgtgttataccaatagtagatggtagtagtaattagtatttatattattaaatataaaaattatattttatgtattataagaatataataattctcatgagttgttaatctatttttataattttaaaatatataactgggagtactcttctggtttttgagggtctaggattcaataacttctgtttcagagatgaataaatatagatgaatagtggttatgatatagacgatgccccagaaactgaaatggagaatttcattccagtcctatttgtagcccaaactctatgtacaaactacatgggaaaagctgacatgtaacttgagtcagctccacgttaaacacacattgagtacctgccataggcattagcaaggctcatcattgtattgctggtgagatcatgtacaaaaataattttgcaaattgaaaaatacacataaatataaaagaattttttaaattgtttgtgctgcttccttaactcagggaagcctacaaggtgccaagttctgtggtaagtgcttcttaaaatgttacttaatccttctcacaactgctctgaaaagcaaggtcagagctcctggttgctggtggttcaaaaagggttcatttctgtctgctgagagggctctgcgatctgtgagttcgtggtggccaaacatagggagacttccaagtgaaaccctcgttgatgacatagtgaaactgtgagtttattgaagtgggaatacaccccctcctaacttaccccacacagaaacagatctgtgcaaacatgcttgtcctttttaggatgatacaataacttttgagataatggaagatactctggaatcttggaagtcagtgagaggaactactggcatagtagttcttgactaacagaaaggcaggagttctcacagactagggttagctgagagacagtgatttggccatctccaacctatgcaattactcaggggccaaaggaaagacaagcccagtttaataaaacccaacagcagggatgtagagaatcaataaatgttggttgatgtccacagggcagcttggaagcaactggaagaccttttacagctggttatttttgaacaacaatctaagatgtataaaagcagaaataaaaataactgaagaaaggagccctgacttgctgccttgaaatcatgagtgtgctgtggttgatttgtagctttttgcagtatggtcaagatgacccctgattcaatacctccttttcctaccacctgcctcccctgggtgggggaggggaaaaccgtgctaaaatattctatagaaccagtactctaagaagcagcctctatagcaaccaagcaggtaggaggtagctgctgtagtttctatcttttacctttttcctccaaatatccagatttctaaggggtgagaaaacacaaacaccaaaaacatcattggaattttggattaaagacaagacagctatctgtcttgtctcatttttgatacaccagctgataattgggctatatctgagtctaaaaataacacatagtacattaaaataatattccttggctacaattccaaagtggtattctgggatttctgtgcattaatcctgtaacaataacaggatttgggcttttaactcccctggtgtagctttgaaaatctagcctaaagcagctaatgttgccgtttaaatcatcctctcactatccttagggaaatgtggagattaaaaaaatgacagcccaactgctcaaatgacctatacctgggagaataagagaaacaacctatttcctctcaggaactgggccgatcaatataaatatttcaaaaggaccatcatgcaataaaggccttggaatttgtatcctacatcagagcaccctagatatttccaacatagacctatcaggttttccacaagggagggagacattgtaacagttgaataactggaactgaactgggttgcacgtgtgtgagcctctgtgtgtgtgtgtgtgtgtgtttgtgtgtttaggaaaggaagggaaaggaggccattattattgtgtatgtttctggtaaacattctttttttcccctactgaaacttgggcgtatcccagaaattaggtgctgttaatcgtgtcagctaaaaaaaaaaaaaaaaaaaaaaaaaaagcatgttctaaaatatgcacacagttctaaattgaagctctaaatagctttaaattgaagtggcaggagtttttcaatgataccattaattgcatttcattaattgggaaaaagagcttttgtgtagctgtggttatgatgggctggatttaatcagtgtaggtaccactaacaggctggcactgctttcggcctgcaatgcctttgaaattctaaaatggaaaaggaggccaacacactgagcaattatttcagaacagattgcccgttaacatttcataatatcaccgaaatacatcctttctgggacagagacttgctttggctatgaacatccaagaggtggcagcaccccatgctccgttggctttctgcatccctccagatgagagctcaccgcagaggtctcatcattgcgtcacctgaaagccagttaggagggcggaggtgggggggaggtgatggagggaagaggtagcgttttgtatttcagttcttctggaagagttcaggaaacagctgcatggattgttttaaatggacttgaaaaggtttttcttttcttttcctccctgaaatctactgccctgtgcagtatctctctatgaagaccacatgagtgcacttacgtgttctctgattcactccctgagggaggaaggaagagtttcaattgcctgggatcccctgagacctcattttcaattctctgcacttgtcttttataaacacaggaaggtgggatgaagacggcattattgacaattattttttgagcatgtatgtgggcagggcactgaccacatcatcaagaatgtgacacagtcggctgctaggataattctcttcttccctaactgttcctccaggtcccccatacacatagaaatctcatgctaaaaatattttacacaacaaatagctgttgagatcgcatcaaaccctgaacaataaggagcaatataaccttacgtgctaggtgtcatgtgcctgatatgagaagcatctggtgacatgggtgaaggagtgtcagggctggtctagcctggccactgtccaactatctgtggaaactggccctcgtcatgctaggaagtgtgagggcaagagctggaatacactgaggcagccttgctgttgggggttattggcagctgttgggggttagagacaggactctcatgggtaagtagtgtgcaaaatgccacaggaggctggagctgggctcagcaacagtctagggtccagcacagctcagctgtgggcctatccccatcctatccagcacagggacttggcctctgtgtacaccactacggctgcttggcctcaccttcaactctgtgtaccttttccttaactcatttcttcagcttagtcttgaccttgacaccctcataccctctgtcccatagctttcctacatggcacctgctctctgggtacatctttttagcttctggtcccactaacaattcagagactattttccctgtatttcctggttaattttgagggaagtgtggagggggaagggaaggaggaagggaagagagactcattggctgagttaattgcattcttcctgtctggacagagctttggaggccaggccatctcccaggggatgagttaggctctgcttggccacctttgagtcacttttagacctgtgcagggctgtcccccagcctgggctatgggcatggttgttcccttcaggaggaccgtggatgtggtagacaccaaatttgacatattgtccctttccccatacaaaggaaggctcaacgatgctggatatcctgctgtcagggtactaccctggtgagttgctcagactctaggaagagagaaaggaacctcttttcttctttacaagaaagcagtcatgaagcttggagaatacacataagagtgataatttacactcaatcttcaatgattccagaaacttggggaaagaggtacagatccttcatttgaaccatgatgccatgtattttgcatagcgcagcttggtttggactaggctgagggaggggagtggctgagttagataccagtctccttgttatagtcaagtcttccttaataaggtctcaagcttgcattttaatccaaagacagattctcgagtgctacctcttggtgctacttctaggcgccatgacatattcagcaatgagctcctcacctgttgcccagtgcattggcagcatccctggttgatgcagccaagccatctggagcagggcaaggggggcacacggggtatgaaagccagatagctgccagatgctgcagtttcttggctgtggccttggccttcctctagtcctttcactattatgctgagggcatgtggcaaaacaaggcaggccccacgggcagcttatttgcttttggctacttccagttgagccaccaagaacttgaggagctttttcttcttcagctatttttcttgagagcctgaacatcccctccatctcttccacttgtagcgcttgtagtcagcctcagccataagccactgacaagagtgtattaactgcagatgtgaggatgaagcaagggcaaactatggttagttttcagaggtgactgagccccttcaacatatagatagggatttccatatatggtgaattttgtcactaagtgcttggctttgtggcatcctatttaccagtatttgaagcttttatttaacagttttattatgtggttctctctggtgttgagtttgagctcactaattagatcattaagttccttgaaagaaagacagggcttctatactcctaagcatttcctgcaatgtgtaacacagcactgtcattgtacaaggaattggcactcaatgggtgtttgttaaattgatttgacccaatctcaatttcatgttcagctcaggagatttcttattaagttctaaggagtttagatcctttctggtcatctatacctgaaggtataaattcattttgaccaattttccaactttaattttctcttgtgcacttcaggaagaacagcaccccagacatgactttttcagggacttggaattccagatttcccctgggattcaaggcatctgggagtttgacttcctattttttacttttcatctctgtcctcttgaagttaagcatggtgatgtgacttactttggctaatgaaatatcagatgtaatgtgtgttagcctcctctgccaaattaatctcctttcctagaaggataggtgaagttatgcagtggtaacaacagcttccaaaacttagtcgagattctgtttgacagagtgactcagggacccaattgacagacagtctgtcatctcagtgtgtgctgccgggatcactgtggcaggggaagctggcatggataatcgttcaccaactcttagctaactcttccaccctgaagtgacacacattacaacagatagttcattcaagaggatggagaagtgcagtcctttcctggctctggaaagaaccaagagccaaaaatacttgtgacctctgtagaactgaccacacctcctcagagagcccagaagttgctgtgtttcagttcattctttaataaggcatgggacgacccttgggaataatataaatactttatcctttgaggttcacaggagttaagaaacaaacccgtattaaagatgatttatgtattaataattaaagattagatttttaaatattatgtaaatatcaggttattttccaccaaatcagtgatcagcagtactcagttgtagcactctctaaatgccatagaaacagatggctgatggaagtgattggacgtgtttagagttgccagcccttttcatgcttctgatgcttcttacacctcacagtcactcaaaggcccagcagctcagagcccttctccatcatcagagtcacttcagactcctgggctctggggatctgatctttattccctgccctgtgattgactctgtcagtcacaaagcaagactccaggttcttcaaaagcaaacagggagtcatcctgcctcacttagtggtcctgtgttccacactcactcgataacttccctccttccaaagatacaattctaggccaggctcagtggttcatgactgtaatcccagccagggcaggggaggcacttgaggtcaggaatttgagaccagcctggcccacgtggtgatacccgtctctactaaaaatataaaaattagccaggcatggtggtgcacgtctgtggtcccagctacttgggaggctgaggtgcgagaatcgcttgaacccaggaggtggtgtttgcagtgagccaagatcgtgccactgggcgacagagtaagactctctcaaaaacaaacaaacacaaaaccaaaaacaaagatacaattctaaccataagaaccaggagtttattcacaagtgtaatgagtttagtagtcaatgctcttttagcccaagtcaatggactattattccaacatgccaagtaagagccaaccatgatatgattgaaagagcttttgcattagaatctaaagactggttcaactcccggctctgccatgttctagctgtgttacctaggaaaaatcacttggcctctctaaaccttcactggtaaaattaggataattacacttaccttctaggatggagtttcctactgataaaatgtaaattataatgcctacctcttgggatcatgggaatttaaattattttgacaaagataatttatgggaaaaatatatatgtataagtatgtatatcccaagctgggaacttcttccctccttttttgcttgctaattaagagtcataaataaaatgctgatgagctgcagtctgccgtctgtgctgtagctggagggctgttttgacttagcctgacaaatggctaaccagccgctcccactatgcccaactcaagtgttcagcactgagaaatccagctactgccaacagcatcttataaacttgtcactatttacttacttggtgacagtgtttttgttcagtgatcatccctgagattttactcgtcagggtgtgtctgtttctctcaaaatgccaaaatgccaaaatgccatttaaatataatcctttctcaaaccacatgaaaatagtgaaggtctctaaatgagactttgatgcccttatagttcatccccattgcagtgcagttggggtgggatgttgtctttacaaagcagtagctgcatgtgcacagggctttattaaatggacacaaacttcagagctacttcaataagctactagtcaggatttccaggtaacctgttgagtggtgtgctagagacagctcatacaagcttggaagaactgattgttacattttcaggaattttgcaaggtggttgaaatcatgttggtagactgaaattggccatggtgagagtgtttacaccatggaaattagcaaacactacaaaatcaggcagtttctcccagagggctggttgctaaacatttaccagctcaccaatctttgagcacctgggtaaaacacagatgtgactgagaatgggagaaggggcatcccaaatcggaagtataaataaaaccatgatgcaggactcacttctctcgagtccctgctgtgtgctaagttctatgctagcctagattgagactgacatatatcaggaggtacctagcaaattagcgatgtggggcctaccaaaaatgtattcatatgaaggacagagagcctgctaggagcttgactgcaagctggtcatgggagagagggaataatgctagatgtaacatggtacttgtcactcaggtttcaagccaggccctagctgagatttgtagagggtgggttggggaaagctttaagtaaaaacagaaaaggctgctttgggaacactctgtaggacaagatggcattgtttggatttgacatcttgtttgttccaggacctcagctgcagtagttttgggacagcagaggcttggctgacccacacagtgcagtggggtgggctcccttgcaagctcttttgcaagagcactttgtggaggaccacagtgtgaacaaagagggggaaagggacagtagaatttattttgatgaccccatatgtactggtaaggcaaaggggaagctggttgcatatacattttctcaacttatcctcacaacacccttatgaaaaaggcattatcatatcctctttgtaggtgaagaaactgaggcttggagggtccgaataacttgcccaatatcacagaaagtaagtagcagagctgggattcacacatgaggctgactgcaaacccttcttggggcctctgtgaccaccctgaattcatgtctgcatattcatttattttcttctaatttggggggaagaagtctctctcttctttccaaggtcaacctttccactcctgcccataaatcctgtaccttcctaattcctgctccagagtctttgtaaagcaccgcattgctctgttgtgcatctttagcctttcttctgtcagtttattcattaatctttgccatcttttaacagaaatgagtgactgtgtggggactttcttagccttctctcttagcctctgtgttgtactgaacacagaacacattctcctttattcttgaaactctctacttcccatcttctgtgattggtttttctcttccctctcaggtttttcttctgatcacttctggctcttctccctttcccaacccatgaaatagaagcattactccaagagtctagtgttggctctcttcttcttgtggtccccatgacctcagcactctatgcagacaaatatatgaatatatctacagctctagttaggaaatgggcagaagtaactcaaccatgtccccaggaccaagagcagtctctggcatgtagtgggtactcagtaaatagtagggatttcagatgaagagaacattgtgaacagaggctgtgcatgtatgtattgatttatttggaggatacccctttcaggctgctgaactcctcaaactcaggaactgtgctttttcctcatttttaatttcctgatccagcataatacatagtagctgttcaatacatgtttgctgaatgaatgagtgagtccaaggtcgatgataaattgatgcaaaactgtggcagtccttatataggaatttaggctttactgtatgtgcagtaggcttgcagccatgcaaggctttttctcatttgagtaactcaattgaagctgagctccaggatgactcatgtggctgccgtcagcattgaaaccttgtgccgtcttcctcccttgcccttgctgttccatctctaatcagtagcccaatcttgttgattttacttccacgtgtggctttatggcttgtatttgtgtttttgtttctattctcatggccacctcccaaggtcagctctaattacctcttgtctggatgtcagcataggtcactccccactctggttgctgttgatcccttttctgtaagccacggccttggctatgctactgatgactggctctgtttgaaaaaaagaaaacagaacaaagcagaattggttctgggaaagcaaggataaagagggctaaagtaacactccattatctgcctttaatcccacaggcccttaaagctgttgcctgctttgggttttacccttgagttgcttgagtgggcttatcccctcattgctccttataacaaagagtaggatccattctcacaataaagttaaattgtagggaaagaaagcggaccaatgggaagcttgtgcttgactatgttgttgaaaagaggcaaaggaaatggaagaacaatcctttagagaagggagaacaagagaagggaaaatgtaaaagaggagataggagaaggccattaagataataattctagagggaaggaagaaaaaaaggagagaagaccagagctgagctcctgccatttttcatagctaattatgattaaatgggccgtttctgaaaatgctcaataaatgtgcactattaccttaaggttttgctctattgctatgcaatgcatgggcattgcatgaactttatcagtccagaattttacctaataaaacagtgagctaatggactttagggggcctctctggggactcttgagcttaagcgatttaggtcagtgttatgcaaagtgtgatttgcctcctgcaaggaggtaagtacagaaatccacagtctgtatttagaaactttatagcattgcacattgctacaatgatgtgcaggaggtgggtggtaccagtcaagagagccagagccagagagatcgtgggcatttcttcccatttttgcagctcagtaacttcactgtggtagcttgaaatcagccataatgggaggtatttttatcatgcaaattgacaaatgctacaaatcaggactcctcccacccttaagaaccgggtactaaacatttgcggcacgccactgcttggctgagaagtccaagcatctgatgaggaaatactatggaacggcatgttgttccactttcttggtgagttacttgtgactggagctgcctacccagacgtgcatggtaggatcacctatctgtcactaaaggaatagaggaaattggtccttcaccatagggagtttgaaatgcactgccctagatcaccttcagcttgttctgagatccaacagagtatttcaacagaggtcttcatgataaccaaatgtaatagcccactggtttagaaacctcctactccagattttgagtcctataagacagttaggatcaagggtagctgtggcagacccagctggggcagagaagccaaatgtgaaatagcagaaggtatgtgtattagtctgttaggactgccatgaaaaataccaaagaattggtggcataaacaacagaaattttttttttttcacagctctggaggctgtaagtccaagatcaaggtgttggcagacttagtttctcttgaggccactcttcttgccctgcagatggccgccttcttgctgtgtcctcacatggtcttttctctatttgcatgcaaatagagaaaccctggtgtctcttcctcttcttacaaggacaccaatcctataggattagggccccacctttattacctcatttaactacaatgatcccttaaaggctctatcttgaaatacagtcaccttgggggttgggactttatacaaaatttgggaggacacaacccagtctgtgtcagtgtgtcactgtgctttacctgtcggggctcactctgcattccaatcaagcatggtatagtgggtcacaagactggagccaaggaggcttgacctgactcccaggtctaccttcccattggctgtgtggctttgggcaccctaatctttcttatcctgcattattcatctgtaagatgaatataatacaagagcttccctcacagtgtagttatgaagatcaagtgaagtcatggaggtaagcttttagcacagtgtctggcccatgataggtgcttaataaatgtatacttttaatttatggttttgctctattgctgtgcatttcatatacagtatatttttaggtctcagaggaggcctaggtgtggagagctgatgcaaagagtcttgtatctcatttttagatccccagtctatcgtcctcatctccaatatcatgggtaagaaaaggccaaggtttttctgacaccccctgttttacacattcactctgaacttgctaaggccgactttgagtggagagccatgatttcctgaagatcaataatgccaaagaatccaaaggcatcacttgttaaccaatttcccagtggcctggcctgcagtggggtgagaggcatcagaaaacacacaggaactgagaatcaatgcactgggaagaaaaccagctccctcaaaggggctaattttcccagtgtgtaaataaattatgtaaacaaatatctgatcatatttataacctctacttctgaaagatccacctaggtgaatttatttgacttttacccactagaagaagtttgtttaaacaatattatcaagaaaaatcatgtagtcaaattgttagactttaaagtcaaaatgggcaattttatacatgaggaaactgatatgttttaaaaaaaatctcctggtgtattaatttgaagacgacaagcttttaattaaaaacacaaaaataagattcttagatgaaaaataaagtatattatacctggttcaatattcttttggataattcaaattttggtgatcagaaaaaagatgcataggcttttgctgcataagatcttgccaagatgcttttactgcctggcattgattttccctctcacccactccaggcattctcacttctgttggatgccccttccactttctagcaatctccaacctcatcaagggctatccctcctccagttccccctggagtcccatctctgttcttgtcttccctgactactcctgcttgaaaagaaatcttcctcacctgaatcactctagcacttttactctgtattgttaatttgccaattaatcacatccacctttgcaatgcctttcatgatatgaccttgaattgcatggttttagggcttgtctatctttttaagctgcaggtaccctgagaaagggacctcatcttactctttgacactcctcccccgtttagtgataattagctgtgtgccttttatagagtaggaagtcaatgaatatcacagagttatctgctttttcctgaaatggttaagatcattttatgttaataagtgtgtgtctagtcaaacttacagcagtaagcactgaggctttttcttttttaattgtagatatcaagctggaattctctagtaaatgctcctggaatgtaatctgggggtgccattgttccagtgagttacagtaatttttaaatctaactctggtgtaaaagagacctgggttgagttctagttttcttggttaccagctgtctgaccttgggtaaattactacctctctgtgatggttaattttaggtgtcagctaggttaagggattcccagacagttggtaaagcattatttctgggagagattgacatttgagtcagtggactgagaaaggaagatctgctctcacccagtgtgggtgggctccgtcaaatcagctgagggcctggagagaaccaaaaggcagggaaaaggcgaatttgctctctcttctggagcttctcctgccttgtacatgaggacttcagggtctctggccttcagactctgggacgtttgaaccagcagcccccaggttctcaggcctttggcctctgaccaagagttacatcattgtcttcactgattctgaggccttggaacttggactgagctataccactgactcctctgttctccagcttgcagactacctgtcatggggcttctcagcctccataatcacatgagccagtttccgtaataaccctgctcttgtctgtctgtctatctatctatctatctatctatctatctatctatccatccatccattctattggttctgtttctctggagaactttgactaatatactctctaaagcccagtatcttcctctgttaagtgtgagtaataataacaccttatctcataaggtggtggcagaggagtaaaatagaaatagtagcactcaatgaatattagatttttatcattaatattattgtgacatacagaggtcaaaaagtagaaaccttacccatggctatcagtctccattcgtctgaaccaagggtaaagagtaagaccggtggccgggtgcgattgctcatgcctgtaatcccagaactttgggaggccgaggcgggcagatcacgaggtcaagagattgagatcatcctggccagcatggtgaaaccccgtctctactaaaaatacaaaaaaaaaaaaaaaaaatagctgggcatggtagtgtgtgcctgtagttccagctactctagagggtgaggcagtagaattgcttgaacctgggaggtggaggttgcagtgagctgggatcgtgccactgcactctagcctggcgacagggcgagactctgtctcaaaaaaaaaaaagtaagactggcacaccagtggcgaattggccatgcaggagctgggtctttacttccctgtgcccagtgctgctggataaggaatataatatttcctgtgcagaattcagaaggagcactttcctatctaggaagaggtgacttgtgaaccacctttggcctcatgttgtcatcacctccccaattcccacttccctttgtaaagcataaaacattttaatacctacaagacactatattttgtgttgttactctggagttgggcaggttgcactgccagtacaatcatattcattaaagataagtcagcaggacatttggcctggaatgaatgatgaaaccaagtcaaaccatattcaatgttttctcagagatgttcaagaaaaagaacaacttcagtggaagaagaagaagataggagcccaggtcctgtgtttcaccaagacagccgtgcaaagcagatgctgccaaaaaggtgcaaagtggtttgtcagctcttctgcatgttctaacaaattagacatgcatcccaaaaggtatactacaatattaaagcttatttatacacactgtaaagtttcccctgagtgtcctggcaggcacttgcatggctgggcagtatccgtggactgattcctttgtgaattacatggagctgacagggctgaaacccacagctgactcggaggaggatggaagcttgtgctgggcaaggggctgaagcccctctgtgtaagtcatattaatctcctctgagcagagtgctacaaaattactaaagctgcttcttgaagacacttctaatgcagtacctaatgaaaatgtcaggtgcgacaagttattagttgctgcactgctgttctgaagtcccaggtatttctctacctgttatccatgaatgtgagttttgtggggaaggcagtcacaggctgaggaaagcatcagcagtcatgtgtgctgtcaggcctgtaaagtgagtgaggacaatgaagctggttgaagtgccccaggaaatggccagacttccatagtggaggtgaggtgaagaattgagtccgggcaaaggtgtgtggggagaagaagctgcctggtgtacgatgctgagtaatgatacaacccaaatcatctgactctgcagatttgaaagttgccgttattattaagaattcagatgggaaaagaaatatggtttgggttatttccatagtcattccagaaatccaggctcagtttggcatttattgacataactgtttatattggatctgtgtagaagtttgtatctttctgacttgcatgatacttcagcctttccttggagtctctgtggcttctcttcctcctttgctcacctccagtcattgtcaaatggctttgtgcaagttactctttctcggcctccatttttttggatcctgcctttgccgccctccttgcctgtactctgtccagtccaggccctctggacctcttgcctggacctccaagctctccctcctcccatctcttccctttcaaccttcctacccagagcacagcagtagtaacagctaacaccatttaataggtatcctttctatgccaggccctggggttgctatgtcacatatattatttgtaatgtttgcaataaccctggaaatggtattattacctccattgtacagtttggaaggcaccaaaaaaggcacatgggcccacattcatgcaagctaatgaggggcaaaactggaatgagaacccagggccactgggtccctcagcttatgctgttccctaaccatactgcttcctccactcagaatcctttagtggctcccattgcctaatagatcaagtctgggctccttatcttggcttctgggtcctctaaaatgtagtctgctaggtttccaggctttcctctccacccctcacacatcctactctttagccaaaaaaacagacaaaaaccctaaaaacaaaaaaatccatttttttatttatacccgtgctttctttcctaagtgcttttatatgtgctatttctcctgccaggagcagagactgtcatgctttcctctgtataagtaagtgttgcccaagaaaacattgaacagaggtgggctagagatccatttattttctggttcacaaagggcatattggatctttattaaatagtctaaaatgtcctttcaataatgtttttctttaatatctttttaaaagacatttaaagtgaatcagaaagcaattaaatgattaattgctgtggctgaattctgctgccctcagcctctgtggatgctatctcaccgattaacctccatttctaagctctgtctgattgagggaagcaatgacagaaaacgcttggcctgtcacatgactgatccttgctgtcatgagccatcgttttctaactgcaagctttcattttcaaagccctggcatgatttcaggagctgtaaaccctcatgtgagtaagtgagcagtaagaactggcagtttttcaatcttaagtctctccagctttaaacccacatttagctgtgattctttttttctccttaagttggacatttttttagtgaatacttttttgataaataaagtggggtgaaggtgaacttgactgagacagatatgggttggtccgtttagggctgaccctggaaaaaaaaagttatatcagtcttgacattaattccgtagtcagagtaggtgagagaggagtagattagtatatagggttcccagccttcccagtacaaccatggactcagagttggggacactaaaaatgtacatgaagtttatgatttcactggtagagatggcccacaatgccagtttggacaggcattactctaaacgtggtggggaagtcaggagacatctactccaaggcataacctctaggacagtttgtggggtatcagggaaggatatatcattggaaagatttctagttgccatacacaaataattgggcttcagtttaatgcataattaactgttctcagtgtgttattagttggacaattggattattacattatttacattagtgtttataggtaatctgaaaacaaaaatgtgaatataatatgaactacctcaaagatttgtctctgcttaatagttttatttcaaatttgtatatcaaatgtttcattacccttttttcattttattttttagctttcaaaacaaattagcaagaggaggaaagaggagagggagaaactgtgcacaccaccagaatgttatagtaggcgatatcatgaaagcaatgttggaactttatactcaggttttgattgtgcatctatctctttgttgtcttatcctttatcttcatttttaccaagtaattattgaccatcaaatgccattatggtaccaacttaagaaatggatgtaaagaattctacagggaaaaaaagcacattgtcagtgtatgaaatttatttagaagacagttacagacacatataaaaatgatagcagcttatgtttgcgaagcactcactatatgccaagcactttctgttagctaataataatatttgctcatttaatattagctcacataataatattaatattattagctcatttaatcctctcaacaactgtctagggtaggtactattatccctattttatggacaaggaaattaagtcaacaagagatgaaataatttgtttacagtcacatagctaggaagtggtagagtcataagttgaacccaggcagtctgaatccagaataataataataaaaaaaggtataaccagggtggaaacttattttgctcttttcaggtttcctagactttccatcaccaccagtgaattctgagtgacaatagtgtggaatttggaagaatggaagagaaactgaagtggagagatggtgaaagagaagaaaaaatgaagaaagatgcttgcaaaaatactgctgtgggtcctgagatgaggattctgggagggtaggtgtggcaatatctcccattctgtgcttacctgggcctcgactggtaccagcagacagggatgggcagtcagttaaggagtgtggctagcgactgttgtgtcatgcattgcactggttttctgctcctcaggctgaaatggatgcccctgacagctccctttgagttcctgttcatctgaagtacaccagctttctagatatgctgtcactttccttctgcagagccacagtggtgtcctgtcttctcagacctcttctcacctcaaatcacttaggactcggccaccagacagatttgggatttcagaacttttcagatgttagaaaggtaaatggtatatattgcatatgtagtatttccagtagagtctgggtcagcacctcataagcaaatgtattaatattttgaccacaacatatatgcatcgtcatcctcaggtcagtagtgactatgtagaacctcatgtcaaaaaggtcagattttttgccacctatggagtttttatgtcaaatatgtgaaaaacttttggttgcagggcttttgggattttggaactgaggataaggtattgtggaccatatcattaccagttccttcctctttcatcaagggcatgagcatgaagatgctgacaaagctgttcctacacttcctgtgctggctgggaagggatctgattcgggctgagccttaagaatcacagttccaagctttcttctcattccagattttagtcgggaaagtaggcattctggaagtagagtccgtatctatactttatatgttccccttaggtttgatgagcaaaaagtaataaaggaaacacaaactcaggaaagaaaagatttttctaggaaagatctatttacactacttaggcctctacccttcttcccttgggagtttcttagcttagcttggaagatcacagattaaagtacaatatagcaagtattattaaaaacaacctgtaaaactgcattatcccaaagatttagcagctaattttctgttgcctttagttctcacatcattttttttttcagggtataaccttctttaaattttatgccctgctctcaaattccttctgggtttaatgactaatctctttatttgtgtttaccctggtgaagcctgtagaaagaaaatcataaattaatggcatatatttgcagctataaacgggacagattcagaaatatacaaacatgcctagtaaccaatttcctgaaattgcaatgctcaactcccaattaaccttagaatttacaagtctaatcaaatggcccagtccatttccattgaaaagctgtgcactgtgtataatctttcacttgacctaaatctgtagtagactttgggaaataaactcctttgtggagccagttgttctattggatgaagtcaatgtccctttttaggaacttgagctaccactttatgtactctaagacacagtttgcaaaggaccagtctgccataccccatgcaggaggaggactgtgttggctcccaccacagggtgtgttctgtggtaatggaaggctgtgctgagtcacttacactgtgtccctgggtcttccttaaggacagtgtatggttttagaagataatagtagcaaacatttatctaccacctctctagatcagctaggcattcttttttttttttttttgacatagagtctcactctgccggccaggctcgagtgcagtggcatgatgaacttagctcactgcagcctctgtctcccgggctcaagcaattctcctgccttagcttcccgagtagctgggattacaggcgtgtgccaccatgcctggctaatttttgtattttaatagagacggggtttcaccatgttggccaggctaatctcaaacatctgacctcaggtaatctgcccacctcggcctcccaaagtcctgggattacaggtgtgagccactgtgcctggccgggtattcttctaagccctttctgctgtgagctcatttaatcttcttaacaaacaaaggggcaggaaccattataatcactgttcaagagatgagaaaactcaggcacagagaggttaagtaaattgtccaatcagcctcagctagtgactgggggagtggggctttgaacctgacagtctttcctaggatctatccacataaccatgaagtcacattggtttctgggatattgcatagcctatggcaaaacctgaatggtgtggagcttgccacacgggcttcattagaacgtaccctatcccggttgcagtgagcggagatcacgccactgcactccagcctgggcaacaagagagaaactccgtctcaaaaaaaaaaaaaaaaaaaaaaaagtaccctcccccagggcttttcaaaccttggggctctgcagaatccctgagggtcatgggaacaagaggcaaaggaggctctggacttctacgcccacatcagccagaaccagtcagcgttttaaatgttacttgctagcactaagagtttatctgagtagggggctctgcagctcacaagaagcttaagaactatagctctaaacaatcaagccagttaactcatacaggggtcataccagttgcaaagggaaatgagatgtagaaaccctgaccccagtgctgtgtgttgctgtcatactctttcttactatagtcagtgtcatagttgtgaagtcagtgtgcattttggtgatgacatttcagggcaaaccagaggctactgcctaggtgccacacggtggtgaccagatcaggtgctttcacagtagaagatgaaaaagcccagccaatgtctagggaggggtaggagagatgaggcaaaaatgctcaacatggtaggaaaggcatgagattaaaaaaagtggtgaacagagccaagggcaggtgctgaaatgagggtccatactctgtgaattagattgttgaaagtagggctgggagcagcagaagagaaacagattgaagatggcaagatgagaaagacaggatggaaacttcccaaggaaattgtagaccacagaggaccccaggaaagagactcttgggtgaagagaaataaaaagctaggcggtaatttttttgttaaagtttatgagattggtatatcagagtaaaacaaaggattaccacaaagcattttaccaagtacctcaccaagttttgaatcaccttgattaggtggtttcaaaactggctaagtgaactttatccaaagctgctgcctactgggagacagaccatcttggagggcaggtatggctctgaactcttcagccttattttgtaaagcaaatgctctggggctggcacagtggctcatgcctgtaatcccagtgctttggaaagccaaggtgggaggattgcttgagcccacgaatttaaggtcagcctcgacaacatggggagacccccatctctacaaaaaatttaaaaaattagtcagacctaggggcgtacacgtgtagtcccagctactcgggaggctgaagtgggaggatctctgagtccaggagtttgaggctgcaatgagctgtgattgtgccattgcactccagcctgggcgatagagtgagaccctgtttctctcaaaataaataaataaatgcaaatgctctgacaaggctctgacactatatgttactaaagaatgatgttctctgatttgtcctgtgtgtgtctatttcctcattgtttatagttgttaatatgggatttctggatgagcctagagggcccatgaatcctctgagattattatactaggaatatctacttacttttctgtctctcttgctagaataggagcaacttgaggaagtgaaacaagtcagaactgaccaaagaaaagtagtgtacatattgatccatggttgagctataattgattcgtgcaatacttattgagtatctcaaacatgcttgcggttgagaactaggcacacaggaagagggatatgaagaaattaacaaacagcaaaataagaattattgttgtaatgtgctttgatagaggaagcacacatgaaaggcacctgctgtagcctgaagaatgagagttttctttctgaagaggaaacatcagctgcttttggaaagacacatgagagttgggcatcctgtaggaggcaaggagagggggttccaggacagagatgagaaatagcatggtgtatgtgctaaaatgcaagttgtttgggatggggatggtgaagggcacctgtgagggccgaggtagacaggtccaggtggaacaggcttctataccatattaagaatttagatttttatccccaaattagatgttaatggccccaaagccactggggccattaaaagattgaaagtagagagtggcatgatggaatttctattttggaacaattatgctggcaacagtgtgaaagatgcaataggaaggggcaagatcatggaccagggaacattgtagaaggccactacagtaactggggtgaaagactgtgttgccgagtgggtgctgtcactctgtgtagcttctattaccacagggacggtcagcggggagcgggatcgtcttagaccatgagggaggatgaggtgctgagagctggaagaatgaagagaaaagtggcctgatgaggaggtggaggtgtgagaagtgacaaagagtctgtgaggagaatgaggaagggcaacccgagaaatcaagaaaaatcaggagacaaatctcctagaagccaagaagatggtggtaaactaataagtgatgagagcagtgaaggaaaaaaagaactaggagggctgggcgcggtggctcacacctgtaatcccagcactttgggaggccgaggagggcggatcacgaggtcagaagatcgagacaatcctggctaacatggtgaaaccccgtctctactaaaaatacaaaaaattagccgggcgtggtggcatgtgtctgtagtcctagctactcaggaggctgaggcaggagaatggcgtgaacctgggaggcggagcatgcagtgagctgagatcgcgccactgcactccagcctgggtgagagcaagactccatttcaaaaaaaaagaacctggagtgtgtttatattgctggcaaaaagagtttgctttcaattgccttgttagcacacctgtgatctgactaagttacatcagtgggaggcacaggatgaaaggatgccggcctctgagaccaacttcagttctttgagtgtttgagaaacacttcaagtcttagccaatggctttggtcaacaatgggtgcctcatgttgaggatgaccccctgagggctttcactgcagagacaagccgacttgttcaaatccattctcaaatggtaaaacacaggcaaaggtacaacatgcagaactactgcaccatgatcaaaacatgtactctgtcacatctaatgacttcaggccctccttgaacttttgagttagcaaaaaagggcaaataaatatgaaacttgcctttcagttctccttatgtgttttttaattgtttcctccttggttcctctgcaacagccctgtggtctctgtctgcatgttcagtgccatgtggggtgacccacacttgtctcagcatcttcaggggagttgagaacagctggcccagccttctgtacttgtcaggcatatggtgggggagacatagccctggcactccaacctcttccctgatttaaagtgtcaaagcattttggaattcaggtctcggtgttaaaaactctccatgaactctgataggcttcagtggtagtcactaccttaggatgctgacgaggaacaactgctatcctgcccatggtgacgaccttcgaaaagcccatgaacagaactattttgaatcatgagtaggaagattagggaaaggccgggcgcagtggctcatgactataatcccagcactttgggaggccgaggcaggcagatcacgaggtcaggagattgagaccatcctggctaacacggtgaaaccccatccctactaaaaatacaaaaaattagccgggtgtggtggtgggtgcctgtagtcccagttactcaggaggctgaggcaggagaatggcatgaacccgggaggtggagcttgcagtgagcagagattgtgccactgcactctagcctgggtgacagagtgagactctgtctcaaaaaaaaaaaaaaaaaaagaagattaaggaaaaactaatctctgctatttgcttattctctgtcagagacacaagaatttgtatgcatcttttcaccctctcccccatcttcttgcagctatttaaagtattttacaaaggagacattccaaaaaggagctgtgactaaaaggtatccataaaattcagatgtcttttggtacagccattacagaaaacagtatggaggtttctaaagaaattaaaaatagaactaccatatgatccagcaattcctcttctgggtatatacccaaaggagataaaatcaccacctcgtaaagatatctgtactctcatgttcattgcagcattattcacagtagccaaaatgtggaaacaacccaaacacccaacgatggatgaaaggataaaggaattacagtgtatatacatatatatacacacacacaccacagacgtaccacaatataaatttatatataccataaaagaagcatatatatatacaccataatataaactttagtatgtgtgtaaataagtaatattgcattgtgtgtatgtatatgtctttatgtatacaatggaatattatttattgttgaaatattattcagtctttaaaaagaggtcctgccatttgccacaatacggttaaagcttgagggcattatgctaagtaaaataagccagacacagaaggaaaaatattgcatgttctcttttatgcgtggaataaaaaaaagagaagctcaagctcaaatacacagagatagagaatgaaacagcaattaccatgggtgaggggtggggagaatggagagatacaggtcaaaggatacaaaatagcagatacataggatgaacaagtctagagatcatgtggtacatgagaactatagttaataaaattgtattagggatttttgttaaataagtagattttagctgctcttgtcacacatacgcaaagtaactaagtgagatgatagatatgtattggtttcactatagtaacaattttactatctatatgtgtcccataatatatctgaagcctcaaatatacataatgaaatttattagaaaagaaaaaacacattcagagtttttttgtttgtttttttttgctgtaaagttcagggggctctcctggcattgacaaagacctaaataacaaatgttttcgcctcacttcctgtcattgctgtaaaggaaacagtcccagcatcagagcaacctttcttagtgttctctgaagggtcatttgtcagttgagagtaaggcacatgcttgaagaagtttcaagtaattctcgtttgcactacttatctttagtcaatctggggattaaccgaagattagagataggcctaccctggctgagctcccagctggtggatgccagccatgtacatgaaccaccttagagaggcgtccttaggcccaggagagtcaccccagctgatggtcaatgacacaggagcagagatgacaggtccctgctgagccttgcttaaattgcagatttctgaataaaataaatggttgttatttttagataaaaattttaattgacaaataatatttagggagcacaactgtaatgttttggtatgtgtatacattatagattaaatcaagctaattaacatatctatcatctcacatacttttttttggtggtatgggcatttaaaatctattctcttagcaattttcaagaatacaatacattattattagctatagtggtcatgctgcacaatagacctccagaacttattccttctgtataactgatactttgtaccctttgactggcagctccatttcccctctctccaccccctgcctctggtaaccaccattctgctcttctatttctatgagtttgatttttttagattccacacatacatgacatcatgcagcatttgtctttctgtgcctggcttatttcatctagcattgtgtcctctggtttcatccatgttgctgcaaatgacaggatttccttctttttaaaggctgaatagtatttcgttgtgtctatgtaccacattttctttatctgttcatctattgatggacatttaggttgattccataacttggttattgtgaatagtgccgtgatgaacatgggagtgcaggtatctctttgacatactgatttcaatccctttggatatatacccagaagttggattgctggatcatatggcagttctacttttagttttttgaggaatctctatactgtgtataattgttatatttttaagccatagagttttgggggtgtgttatgcagcaatagacagtcgggacgcttgatttccaggatagcatgcttctggttttcttcctgtttcactggcactctttgttggcctcctttgattgttcttcttcatccctctgtctttgtttttctcctgtcattatgcaaaattttagccatacacatattagacagcaaagtataatgaaactccttgtgcccattacccagcttcagtatttatctactcagagccaaccttatttcatctacgctcctacctacttccctccacccactccatattacttttaaacaaattcctcagacactctcttctctgttatattcccttggtgatctcacctggactcataactaaatatcgttcacatgcaaagactcctaagtttattaatattacctgtgctgtagcattgtggctcaaagcatgaattctggtacttatattcctgcattcaaatcatggctcttccacaaactactcttgtgacctcaggtaagttccttaacctctatgtggttcagtttcccaccctgtgaaataagagatgataatatttcctgctatgtcttggggttgttgtgaggattaaataagttacatatgtagaatgcttagcacagtgcctgccatatgcaattattgcatttttttaattgtatcttcaggccagacctgcctgaactgcaggcgtatatatccaattgcttacttggcattctcacttagatgccaaatagacatctcaagcttattattctaaaaccaaactcctgatctcccccgcaaactccacgtagctcttctctgtctcccatttcagctaatggcagtgcattccatctttcctttccttagccccaaattccctgatgttatccttgacttctctctttctttcatatcctacatcaaatcctgttggatctgctttccaaatatattataacagagccattcaccattattacccttgtagaaacctccatcacctcttgcctctaatacagcttcctaactgggccacctacttctgcccttcactcttcctctccaccccctcctccaataattgattctcaaactcctggcctcaagtgatcctcccccttggcctcccaaagtgctggaattacaggaatgagccaccacacctggccaataatctactctcagtacaacagagtggtctttttaaacacttaagtcagattatgtcactgctctgttcaaaaagttccaatgctgtctcatgatacaaagtgaacaccaaagtccttgcaatcctctctgatcccattactgtctacagtggctcattttgttccagcctcactggcgtcctttctgtttctgtaacattatggtagggctcccaccacatatcttcaattcagccatacctcttaaaattctctgtgctcagatcttcatggccaactcccttctttgtcttggcttcagtgttatcttctcatctagtgaacattctgatcaataagtctgagtcctggccagccatccccctcctcccatcaacactctcaatccctcttactctgctctacgttttcctttttccatgatgtttatcactttctaacatatttcatgatgtactcatttactttgtacatcatttattctttgtctccctctactaaaacgtaagcttcatgagggcatctttatctgttttgtttattgctgaatctcaaacacctaggacagtgcctggcacaaagtagacaatagatagacagatggataaacctgttttagaaagatcactcaaaaaacaatatacaggatagtttgaaggggagagagaatggaagcttttaagatctgtgcaataatccttgcaagcaataattatgagagcttgagctagaaaagaagcaagaagagagatgagtgggtattttgttggtagaaccaatagaaatggatgacattctgattatgcggtgggaggaagagagagagagaagtcagtgtgactttcaggtttctggcttgggggtgtcacatgaaacaagttttaggaaaagtcacatgtgaaagtatcatgttggaagactgtggaagaaaatatagacctggaattagaaatggatctttacaattaagcacttaatcgcatactttaaaaaatcctatttcaattaatgtatgtgaatagtcttttctatttagattgccacctcatttttttgtttcttctactcacaatgctgagctaatagcaggactttgacaaagagttgtgattgactgataggctaaaacatatattttttaaaacttagttaactacttcctccccaatatttgctagaattacagatttgacacactgctagatgatttacaaattcattttccccttcttccagagtaatagaattttatctggacacatgattactcagctaaaaactatattttccaggtacgcttttaattggatgaggccatgtcactgaggtcaggccaagcaatgatagtggaaacaatatgtgccatttccacaccttagcctaaaaaacaggactgtgctcccatttgatctggtctgaagtgaaacagacccttttgagacccagctttgacatgaagattaagtaaaatgccttggggcatagtagagaaatgagttggaaggaacctggatccttgaatgacctggtggagcagagctgccctgccaagataggcttgcccgactattatttaggagtggaagaaatatgtatcttatttaaacctctgtattttgggagttctttgttttaaaaacttaaccttcattccgactcacaatagataaatgccatcgatgtctttttttcttggtgtcctctgttattcaaacaaaagatgaatacattgaactgagtttttaaaacattaataaaatactcctaattctgctctttgtgttgcccaatagttcttttctaaatgtgatgaggaattacggaatcataaaatggaagcagagttaaactcagacatgtgggcactcaaggtaggtaaatattctggtattcatgacaggttagtcatttgacacatcaacaaactgataatcttaactttctccccatagtattcagtatttttcttacagttttaactcattcctctctttaatttttaaaaacattcttattttatagattgttgcacattattttactatctcaactctttgggcctgctaattctccccatttttaagtctgctgactcattctctctcaaggtagattatttctgcatgtgctttgtgagctcatcttcagcagggttgttttctataaagtctgtgtgccctagagaatggtttggatttgcttctgctatgtgccagtctggaaccagtttttgtattaatttctagcatcttttgacataaatttggactcccaacctggacaaagcacaggcctggatttttgatttttcacccaaaatctctaggaagagacacactcctttgcttatgtgtcacttccctggtctgatgcacagatgttttaatccctttcattgtgggtgtgtaactttgacatatcagctttatttaggagtttcagttctggctctctatttcacatgagcccaaggccatgtctcttgacactcatcatactaaaaacctaccacttaacagatgaggctctgtagttattccagtctcctccctgggccaccgttaccacttcagttttatgtttcctttgcatttctgatacctgggatagcctgtctttcaatttcaaccattttgaaaacattgctggttatattatgtggctcatttttagtctataacatgaagggcattgtgcgttttgcttagttagctactttgggggcatgagataagtttaagtatttttcaatattcatttagcagatctcaataaagctggaaaaaaatgagaaaacctcaaaaaaaaaaaggctgaggtcttttttttgccgttttgtgcactgttttatccccagtacctcaaacagaacatatattaataataatcactcaaaacatatgtattgactgactgactgactgactgactgaatgaatgaatgaatgaacaaacgctgggtgacagtgttcagcctgtcctgtgtagtccagctctggatccaaatatacagaccacactctaccaaagaagagccctgttgccatcccgaccttacctccttagaacacagttgaggactcatcagccgtaacgttatcacaccctttggcggtctctttctcttaacccaagcagattattaaagcatccctttccaccacatacactccctgagaggaggcctgataaatgtaattttctgcactctcaagttatatttccagtggaacttgagcttccaatcatgctatagtactcacaaaaggctggagtcctgggccactgcccagctggtctgttgcttgttcacctctgaatggtggaagccattgtctttccatgcctttgtccatgcacagttccaggaaaagaggattaatttgtagtcagcaggtttagtgctttctgtataactataagagctgaatcaaaaatctccccaccaggcaattaggagctttctgcgatgagaaagggatcagactgatccttaagactttatgcaaccccagagtattgcagccacctgcatgccgaaggtgtcaagagtgttctcactgctgcctataggagggtcttcagcctccagtgatccaaagtaccaggtaaaatatttaagccaacagaaagaacgtgttttattgtgttttacatgtcataaagcattctctatcatgagatatcactctgtatcggtaagacaggcttgaatttctgtcttggttctgccactgactagctttattccttaggctaacctgttggaatctcagttttctcactgtaaagtgaggataattattttatgaggatagttatgaaaattaaataacataatggttgcaaaacacttagcacagcactaagacacaaaatagacaataagtgttagttacctttattcctgtcccctttcctatccagacaaaggctcagtataaggacaaatattgtttagaacttctttttaaacctacgagccttacctttcaagaaccgcagatttgttcctgaaagttacctgtgtagtgagggttttataaatcaaattttactttcaatgtacagaggagctctttgacagagtcccttttcctgagaagtcattgtgggtttggcatcctgttcagcctggctggggccaggggagctgaactgtaatgacaagcagatgtactattgttctatgaaaatagtgtctggctccagatggggtttaggaaaaagtagtgatgatttctgttgaggaggatgggaattctgacccactgagctagctggtgaagaaggagagtaagacatgtgggtaaatgcaggttaagaaaaaggacctctagatcaactgaaagcctactagaagaacattaaaagcagataagaaaacaaggaagcaaacaaaactcgacaagagaaagaagagaccattaggaaacatccaggataattgctgtcatcattaaagctcccatttgttaatctgttacatatgaggcccaacactggatgatttaccaacatttaacctatcctctcacttttcaatgaattggatattgtcaaccccattattaatggaaaaatgggagctctagaatattgaagtcacttggctattaagtgatggagccaggactgggattcagaatccaacactcatattctttccatgaggtgtagattccattgagaagaaggtgtgtgcctaacaccgtgagaaagtcttggccctggtaatgctggtgaggccagtggctgagaaaagaatagctcttacctaaggctgagaacagaagacccaaggttgtggaaaactgacagtggtgcccttcctcacacagagtgcaaagattggtggcttacctgcttcagactcttggacgtgctcttaaatgcagatcctggcagtcagagaggaaaggctgagaaaagttcactctttgccaaagtaataaatccttctctttgatccctcaaaagttgatagacgaaaactcctcaaagcacctaggggtaggaaccccacttgagagttgtgggttctccatttcatcacagggatttgctgtgaaggaatcctgtggtaaactccataagaaaatgtaaataacatcccctctccaatttatcttttctgtaaatctggcttttcatatattaggtttctttacagtaagttgaaaccttaagaatagatttcaaaatatttaggaaatggcctatttattttgaatgatattcaacaccattaaactagagtgttgggagaatatttggacattccataatgatttgacttgtaacttaatataacagaactaaaaacaaaaaccacatgatcatctcaatagatgcagaaaaggcttttgatacaattcaacatcccttcatgttaaaaacccttgacaaacaagacatcacagaaacatacctcaaaataataagagccgtctatgacaaacccacagccaacatcacactgaatgggcaaaagctggaagtattcctcttgagaaccagaacaagataagaatgtgtcctattcaacatagtactggaagtcctagccagagcaatcagataagagaaagaaaaggcatctaaataggaagagaggaaattaaactccttttgtgaatataacatgatttgatacctagaaaatcccatagtctctgcccaaaggttcctagacatataaacaactttagcaaagtttcaggatacaaaatcaatgcacaaaaatcagctgcatttctatacaccaacaatgtccaaggtgagaaccaagtcaggaacacaatctcattcaccgtagccacaaaaagaataaaatacctaggaatacagctaaccagagaggtaaaagatctctacgagaattataaaacactggtgaaagaaatcaagagaagacaaacaaatggaaaaacatttcatgctcatggataggaaggatcaatattgttaaatggccacactgcccaaagcaatttacagatttggtgctatttctatcaaactaccaataacattttttatagaattaaaaaaaaactattctaaaattcatgtggaaccaaaaggagcctgaacaaccaaagcatttctaagcaaaacaaacagacgaaaacaaaaaacccaaacaacaacaacaaaaaccagaggcacactacccaacttcagactgtactacaaggctacagtacccaaaacagcatggtactggtacatagacacatagaccaacaggttaaagaatctagaaataaaaccatacacctacaactaattgatattcaacaaagtcaatgaaaacaaccaatggggaaaggactttctattcaatatatgatgctgggataactggctagccacatacagaagattgaaactggatccctcccttttaccatatgcaaaaattgagccaagatggattaaagacttaaatgtaaaacctaaaactataaaaaccctagaagaaaacctaggaaataccattctggacataggccctggcaaagatttcatgacaaagactccaaaagcagttgcaacaacaacaacaaaaatagataaatgggacctaattaaactaaagagcttctgcacagcaaaagaaattatcaacagagtaaacagacaacctacagaatgagagaaaatacttgcaaactatgcgcccaacaaaggtctactatccagaatctatagggaacttaaataaattaacaagcaaaaaccaaacaaccccaataaaaaatgggcaaaggaaatgaatagacacttttcaaaggaagacatacacgtggtcaataagcctatgaaaaaatgctcaacatcactaatcattagagaaatgcaaatcacaaccacagtgagacaccatctcacaccagccagaatggctattattaaaaagcaaagaaggctgggcatagtggctcatgcctgtaatcccagcactttgggaggctgaggcaggtggatcacgaagtcaggagatcgagaccatcctggctaacacagtgaaaccgcatctctactaaaaatacaaaaaattagccgggcgtggtggcgggcacctgtaatcccagctactcgggaggctgaggcaggagaattccgtgaacccaggaggcggagcttgcagtgagctgagattgtgccattgcactccagccagggtgactgagcaagactccatctcagaaaaaaaaaaaaaaaaaaaaaaaaagcaaagaaataacagatgctggtgaggttgtggagaaaagggaatgcttatacactgctcttgggaatgtaaattagttcagctactgtggaaagcagttcggagatatctcaaagaacttacaacagaactaccatttgacccagcaatcccattactgggtatatatccaaaggaatataaattgttttcccataaagacacctgcacatcgcaacactattcacaacagcaaagacgtggaatcattctaaatgcccatcaatggcagactggataaagaaaatgcgttacatatacattaaggaatactatgcagccataaaaacgaatgaaatcctgttctttgtagcaacatgggtggagttggaggccattatcataaatgaattaatgcaggaatagaaaaataaatactgaatgttctaacttataagtgggagctaaatgatgaatacacatggacacaagaagtaataaacactggagcctatttgagggtggagtgcaggagtgagtgaggactgaaaaactacatattgggtactgtgctcgttgcctgggtaatgaaataatctgtacaccaaacccccatgacacgcaatttacctatgtaacaaacctgcacatgtaccccctgaacctaaaataaaagttggaaagaaaaaaaaaatgaacctctgagacaatattataaaaattagcacattcaaaccacggaaattgtcaaagtgtagctaaaatattaaaccttttagatatgttgtctagatataattatcccattttatagccagtgttatggacatccaaagacaatgtcaattttgctaataaactgcatcaaataagtgcatgggaaaaaataaaaagttgatacattaaaaaaatgtttttgatacataacttttattttgaaaacttgaaataaattgccattgtgaatttggcagcttttaccctggcatgcctacaaagaatgtgatatacatttaatcacgaagaatgccacccagtgataacagtggtactggggttatgattatgttttaatttgttttgtgcagaaaggcatgaccatttgcaaagctgtcctatgaaacgtatcatgtactagtcacctcatgttatcagcatgctcctggaggagtaggcaatggattttttcaccagttcgcactgtgcaatctcttcctcatgtgtgtgaactttgtgggatgtcaagtaccccattaaaattgaatgaagtatttgaggggctcccacaaaccctctagtgatcttctttcaacaaacagcattttattgtgtaaattagaaaaacaacacagagtctggcttaaagaggatggaaaactggcattacaccaagaaagaacctgaacttcagtctttgacctcaggagacatccaagtattaaaacagaattttttttttttatttacatggaaaccctgatggaccaggaaattctttataatgtagagtctggtgctaagtcttactttcaggtgaacccaaatgaagattattgaactcactgttgaatctcatcccctgtctttttaacagcagtaagacccctcttggtcagccacaatatggggaaactcctcagcagctgctgttatccctaatattattgatatcacttctacttgctcttgctatgtttgtttcttttcagcagagctttcacagtactctaaaaagtagaggctcttaacattaaaagtttccttagccttttcaataaccctttcctggttgtctatgctggtggcagcctcaacctgaacctgagtgaatttgtttttctggcctgagctttgctgagcctcttaaggggtagaccgtctatgtgtgtttcttttatgtgagataaaacgcacaatttattaaatatcttctgattcttagacaggatctcaagggtggagctactccagggctcattgattttcatggctttttggctgtttgaaaaagagcctcctttgacatcatgtgggtttttgctatttctatttaagggtatatcttacatgtcagatatattattattgctgttttagttctagacagcaagtgatatgagcaaacaacaaagcttccatgctgtgaaattatgcatttattaaagctatcagttgacacttagctttgaattatttatatttttctataaactgtcgacaatcataacgggaccagaaccataggttcatatgggaaggtgatttactcatcttcctttcttgcccttaggaggagttgcagacagagtattatctttttttttttttttttgagacaaagtcttgctctgttgcccaggctggagtgcagtggcgcaatctctgctcactgcaacctctacctcttgggaccatgcctggctaatttttgtattttcagttgagacgaggtttcaccatattggccaggctggtcttaaactcctgacctcaggtgatccatctgacttggcctcccaaagtgctgggattacaggtgtgagccaccaggcctggcccagagcattatctttatcatgactttttcctttatatgtattgactatttgcaggtgtatcacaactacaggagacagaaagggaagcggtatacctctttctgcatgccttgtgtttaaagcgtgcctagattctgataaaggcttgcctgacagaaaaggcagaatgccaggggtctatcccaagatactgagtcattcctgtgtccttaaatgccaaagaggtaggatcaaaacaccagatctaaaacttgacaatataagttgttagacttaatctccaccagactcaacttgtatctcagcttctcactaatctcctatttctcattcactcactggtaccttcagcttattctctgttttctcctttgtttgtcaggttttggcatgatatctcagacactttttttctccttgcttcattcagccagccccaggtgatttgccttcccagaccactggctttctcctgaaaagagaagacacaattgacttctggtctttcttgctgtccatactacatagattgttattccaaagcttggtccaggctgagttcttggacactgctttaaatgagtggcccttgaccagaagggagatctagaaacaaacacaattttcctggggaagctgaggcattgtgtttgaggcccacgtatctttgtactccttccgtcctgtgatccagaagtctatttatgccagtcttgcttcaacctctctcacaattgcaggggaaaagtctactgaagggagagaacatttcagctaggggatataacttaaggtgagaaataaaagtgagacgaagaaaacatgtttggtgaactggtttgaccagaactcatgtttcaagttggaaatgttcaaataggaggaagataactaaggtaaaaatattaaagactactattaaaaatttggaattcaatagttaaacaccacaattagagatatttttatgacattactgatattaggattgtcatttactgagaaaagtgtgtaaaaatctcccactatgattgataatagaatgtttattttccttgaagttatttcaattattactttatttattttcgagactgtgttattcattgcatacaagttgaggattgtgatatcttcctcgtgaattgacttttgtcatcatataatgactttcttacctggaacaatgcattttgcctttaggattactttgtatgatattaatactttgtcaccagctttcttttgtttaatgtttgccccatagtaaaatattatcttgccttttggaacatcttggaatttttcctcctgcctttctaacctatcttcactgtgtccttctatttcttctttttttcctcctactcctgattacccccaaaacccaggccttgaacataggggtatatctgtgtgtgtacgtagatgcacgtgccaacttttttatctcaaggctttaactgttactctatcattgaaactgcatttcacaccttctctttagtctcaaattcccaactgccactcatcatcttcccttcccttgcctatatctctactctattctctttttctcttgggcttgcagccttggagtcaaccttttttccgctttatgctctatattaagctgtcataaatgccatgacctttgctgaaatgcctaacagattctcagcaataagctcacagggaaagggcaaagccaggagtgcaggacgaggggaggatcagtggcagccatcctgtagattatctactgaaattctttccattcctttgaatttctgctcctttgaagccctggattataataattatcttggaaagtttttcagtccgagatccaaaaattcttaattgggacctcttcagtgaaaatgacattcagtgaaaatccctggcaacattttcctagatgagaaaaagaattaggaatcagatgaagacgtgagaaagccatgacttcacaatgtgtaaagcatgtgctgatagcttgtggaagagtgtcttaggaggtccctgtcccaatgaggataacttcttaatcagaatcttgtttccaagttctccctcaactccaggataaactttaaaaaggaaaacaaaatccttgctagaaaattttccatcatttttctcttttctgtatgagtagcatggatgaaagagttctgtgactgagttgaggtttgcatctaactattgagccatggcaaaaaatattaagcatcactatttgttgtcatataaggaatttagtggggtttgaggttttaaatgttattgtttttctctatagtaatatcccttcaatccccttggttatctttctagagcaatataaaatgacctgacttctgtgagaagtctttagcttttggaaatcctcacctaggtttctttcacctagagaattggtttctgagaaaatcctccttccttttactgaacagtgaactgggagcctttaaatggagtggaggtggaggaagatggaagtgaggcaggtagaatttgtcattctgtccccctgggagaatgaggaaattagcatccagttctctagaacctagagtttcagggatctatttgagtgggaaaaagcattccttgtttttttgtgacctacttaaacattctgtgaaagttgtaatcatttgaggttttctaagaaaagaaaaaaaaaagtctaaatataatcctaaaagggagctaacctaacaacaaagaacacccggttgcagagattatttctctggaaattggcaaaaagagacaaaaatcttccctggcgattactggctatacctgctgctacacctgatttcatgctttttattcctggcagcactattggccttctccaatgtgggcttctccaaacttcacacccaggggcacacaaatcctatttctcccatctggaaagctctgctcacttcttcccaagtccgcttcccacctgcctttgaaatgcagctaaagaccacttcacagagattccctcaatgctagctcttccgctatgcccttcattctttctcttaaacccctagaactcttagaacctgttaacagtgtatgacatcctaagtgctctaattcagggacagcagagaatgcagtccaggctcctggtccagtagtggggatggattgtgctggtccacccgcatgctgccattcagtctgctttatcgtgagcacttcccatttgccagcaggggctaatggtgtaggccaaccatggaagaacgtgaagctcatctcagtttagctgactggatgcagcctgcagcaagcatgtgttgttgtttcatacattcctgtctttgctctgtgtgcacatttgggtttcatcttttcctcctagcggcacacgttcccatagactttgtgcttgcatgtattaaggaacattgcgttgtcaaaaggtaataataagagcagctaaaaattattgagaacacgtgatgttgtaggcactcttttaaacatttttatatgcatttaatccttgcaacaatactgtaaggtagttattatcccattttatggatgaagaaaataaagtactgagaggttatgttactttcccagggccacatggctagtaaattctaaagcccaagctattgaccttgagcctatgctcactccaggctttggagttgtaggagatgtgcaaggcttaatgaacactgagtgaacttatgaggcagttcagtcatctgacatcctcattaaatctgatttgaagaaatgacagagagaaagttgatagagcttagaaatttggttctaggtgagaccttaaaagtcatgtcaccaaggaataagagaccctcaagaggttagataagtcctctgtgcatcatttcctcctgacctgtatctcaacgtcaaagctgtcaacaaaaatgaacagggagcagcacttagtttgtatgatgtattcataatgtttggggtgccaaacagaagtcttatgacatggtatttttgcccggctaggtttttctatactagggcatggccatggttttaatgctttatttattaaagttattagaagataaatatgtgcaatcattgaaacttttcttattttcaaataagaaagggaaacttaaaaaatttagatttagcaactaacttttatttagaactgccatatgatctaacataaagttttcttacaatctgaatttgaaacattcaggattattttactaagatctgaaaaggtaatttgacatactatctataaaagtgtgaattaccctggggattaggaggtgaggttctgtagtaattaggtatgccaaaaataattttttaccctcctccccctcttccttctttcttttctgcatttacatgtattgctcttggtctctcatgtcattctttcaggattttctaatgtaatgaatttctctttctctaccctagagagtaccattatttccattctttcatggaactgtaagtgtgtgcaatttgttgacctcgtggtatttcaaagaactgtaaaatctcaattatcaggaatgcccagggaaaggggcttttaatggaatggatttttctcttaaactgaaggttaatcaggactcttctctcccccccgtttcaaatttattggttgcaattttttttccctaatctgtgagtgtactttctgggctttgctgaaatgggaggttatctgattgactagcaatcataagccctatgtttaagtccacattcttccatttgccagctctatggtttgaggaagttatgacactgagccatttgaaaaatggagatagcaacacttgtcctacctatgtcacctgggctgtttagtgtatcaaattatataaagacaatggacttgctttgtacaagtcttaagttttattttaatgaattatgacaactaccaagttctgagtgcctaggggccaggtgctccatacacattattgttatttccacaataaacctactatatatatagatgtatatagatgagaaaagtaaggcttgggagataagtgacttgcccaagattatgtaaataacagtggaactaaatttctttacagcaaattgataccttgattaatcaaaagtctttattctaagtaccatttcttgtggataaagagagtatagaagattgcctagaagcatactgaccttaggatgcattgttttgcttagggttcttttagttataaggaacagagatgttaggtttcagagggatttcagagaaacccaatgacagaaattgaattatagttgggtgttaaggaagctgtcatgaatcaagcctactcttgcctctcctctttcttctcctctccttccttcttttcgctctctctttgtccacacaggcaaaatcttccttacatatgtggccttcactctcttttgtctattgactggcttcctcataactgtagcttgcatatggttcatcatatggtttgggtctgtgtccccacccaaatctcatgttcaattgtaatcccccatgttggaggaggagcctggtgggacgttccttggatcatggggatggtccttcatgaatggtttagcaccattctcttggtgctgttcttgtgacagtgagtgagttatcgtgagatctcgttgttttaaagtatgtggcacctcccctgtctctctcttcctcctgctccagccatgtgaagtgccttgcttcccttttgccttctgccatgattggaagttccttgagacctccccagaagctcctgtatagcctgcagaaccgtgagccaattaaacctcctttctttataaattacccagtctcaggtatttctctatagcaatgtgagaatggactaatacagaccgtagtagggactctacacctccatatagcatagtatctcttgatctgtccatttagcttttgccctgttgcttactggaaattctctaggtcttgtgattcagattcctgaaggaggattcttactggcccagctcatctattctagtcagatcccaggtcactgactgctacaagctcatggattggctgcttttgcatcaggtgtcctgctttggtgctgcccacttagcaaagctaagggaagactaggaaataaaagcaatgtgacagctacatctatcatcactattaaagaaggctatatatcacgatatatttgtttttgtaaaaatccttaatattttattgttatcttttagttcttattctcttcttttcaacgtagtccctcgtctttcaaaatatttctcagtaattgggttcctgttgactcaaattttatgacacagaaccttgtttataacctcctaacttaccattactaatatcagttctgtagtcatatataccacaattttatatgtttttgaagaaggtagtaggaaaatatgtcatagtttaagttttatactaagcataagtcatgtcatagtagaagtcttttttctattaatagaagatgtcatgtctcaaggttattgttggaatataccgtaattaatttttttaatccttaaaataggagaattgagggtttccgagtagtgtgaatacatgaaaagtgaaaaaaatgggtcatcttctaggaaggcctgcagaacttaaaactgagaacaggccttagacttgctttctttcctctcctggcacttcctgggttttgttttcctccctgctggtaggttttgatgggaaggcattatatttctgtttatctgaatatctattttactcacaaacttttttcttttatcatagctgatatgaagtgaaaacatgtatcacttggctcagcctgaactgctgtgtgataggatgtccctgtatcaaccatgaaccagaagtggaacagggacctaattaatatttatgctgaccttggtggctgttgtaaaataaactaccatacatctaaaacctcaccacactgggttggatagctaaaacttctatactattcatggcttaacttctgagatttatatgcctcttgaagagaaagtactcatcactgctgaaagtttaactttctatttttgttatggcctccattacatttccaaatattcctttacttaattttatccataaacctgaagccttcactttcttagtgaggtactagattctttgtatataaatttgactgtattggaaagcctgggtccatgtgtttttagtccttaactctccagtccttgtagatttccttgtatataaacactttaactgagttatagaacctcttcctctgtgaactggtgtcaggctctggtggtaggtcctcttcctactctacatgctgcctaccctcttgtatggaaaaagattaactgttttcctcacactcagcgcaaaacacttctggtcaccaaaacgtgtgggtttctcccacacaaagcaattctctgacaccagctggatatcctacagttcagttcaattctgtgctaactgaagttggcacagactccacgtgttaagggctcagcccctcaagactgtccccggcttcagatgtcagtcactagtggtagtttcccatgttacccatgacttgtgtcagacttggctgtaaactggagggtcccaaagcccccttctctggtttgatcacttgttagaacagctcacagaatgaggaaggtgctttacttattattagccattgattataagatgatataagtcaggaacattcagaaggaagagatgcacaggtgaaggtatgtgggaaggggtgtgaacttctgtgccctctctgggaccaccactctccaggtacctcctcctgtttggcaacccagttatggaggcttcattacataagcatgattgattaaatcaggccactagtgattttttaaaaaatttaattaacacctaataattgtacatctttatggggtgcaatgtgatattccaatttatgtatacatgtgtaataatcaaatcagggtaattagcatatccatcacttccaacatttacaatttgtttgtgttgggaacattcaaaacctctcttctagctacttgaaaatatataataaattaacgttaactatagtcatcctacagtgctaatagaacgctaaaactttttcctcccatttagctgtgattctgtatctgttaaccaaactctccctcttccctacttccccctacacttcccagcctctagtaactactattctactgtctatttatataggatcaactttttcagctctcacaaatgagtaagaacatgtggtatttttctttctgtgcctggcttgtttcacttaacataacgtcttcccagctcatccatgttgctgtgaatgataagattttgttcttttttatggccgattagtatttcattgtgtacatataccacattttctttatccattcatctgttgatggacactaaggctgattctatattttgtctagtgtgaatagtgctgcaataaacatgggagtgcagatatctcttcaacatactgatttcctttcctttggatatatacccactagtgggattactggatcatatggtagttctatttttagttttttttgaaaaatctccatactgcttcccataatggctgtactaatttacatttcaaccaacagggtataagaattcccttttctccacatcttcaccagcatttgttatttttttgtctttttataataaccattctaactgaggtgagatggtatctcattgtagttttgatttgaatttccctgatggttagcaacgttgagcatttttcacacacttgttggtcatttgtatgtcttcctttaagaaatgtctattcagatcatttgcccattttaaaattgggttatatggtttttttgctgtttgctgtttgagttctttgtgtattctggatcttaatcccttgtcagataaatggtttggaattatcttctcctgttctacaggttatctcttcactctgttgattgttttctttgctgtgcagaagcttcatagtttgatataatcccatttgtctatttttgcttttgttgcctgtgcttttgaggccttatccataaaatctttgcccagaacagtgtcctaaagtggttcccctatgttttcgttgagtagtttcatagtttttatccttacttttacatctttaataaattttgggttgattttatatatgatgagagataggggtctagttttattcttctgagtatgaatatccaattttcccagcaccatttactgaaaagggtgttttttcttcagtggatgttttcagtgcctttgttgaaaatcagttggctataaatacatgaatttatttctggtgccatttgtctatgtgtctttttatgccagtaccctgttgtttggttactatggctttgtagtgtattttgaagtcgggtagtgtgatacttccaccttcattctttttcctcgggattactttcactagttgaggtcttttgtagttccatacacattttaggatttttttttcctacttcagtgaagaatgttaaaggtattttgataggaattgcattgaataaatagattgctttaagtagtatgatcattttaacaatattagtttttccaatccgtaatcttgggatgtctttccatttttttgtgtcttcttcaatttctttcttaagtgttttatagttttatagttttcaacgcagagatatttcaccttcttggttaaatttgttcattttttttatagttattataaatgggattgccttcttgtattagtttgttttcacacggctataaatagctacctgagactgggtaatttataaacaaaagaagtttaactgactcacagttccacatggctagggagacctcaggaatacaatcatggcagaaggtgaaggagaagcaaggcacatcttacatggtggcaggagagagtgtgtaggggaaactgccacttttaaaccattggatctcatgagaactccctcactatcatgaaaatagcatgggggaaaccgcccccatgatccaatcaccccccaaccaggtccctccttcaacatgtggggattacaattcaagatgaaatttgggagaggacacagagccaaaccatatcacttcttgatttctttttcagctagttaattgcagtatagaaacactattgattttggtatgttgattttataacttgcaatttcactgaatttgtttcttttctaagagttttttgatggagtctttcgatgaaggtttttccatatataagaatatgtcctcagcaaacagggaaaattttacttccatctttccaatttggatgccctttattttgttctcttgcctaattgtgctctggctaggactttaagtattatgttgagtaagagtggtgaaagtgggctttgcgtcttattccagttcttagaagaactccccccaaccgccattcaatatgatgttagctgtgggtttgtcatatatggcctctattgtgttgaggtatattatttctgtacataatttattgagagttcttgtcatgaaaagattttgaattgtagcacatgctttttctgtgaatactgagaggattatattagtttttattcttcattctgttgatgtgatgtgtgatgtatattgatttgcatatttgaaccatccttgcatccttgagataaaccccacttgatcatggtgtataattcttttgatgtgctattgaatttcttttgctagtattttgctgtggatttttgcatctatgttcatcaaatatattggtctatagttttctttctttgttgtgttcttttctggttttggtgtgagaataattctggcctcgtagattaggtttggaagaattccactccccacctccattttttggaatagtttgagatgaattggtgttagttcttatttaaaagtttggggagtaacaacagcataatgttagaggtgcctagtattcattccccttacaagaaaaaaccaaggcaatgaatacacagctaagatttgactggagtgtgggaaggagcaccttggaaggcagcaaagaggtggagatgcacctgtggtaaatggaagtccaggagggcagcacgcaggcactcagcctctgaagctctgtctgccccacccagattagatatgtctgaagtcaggagacacttcctgttctggcaaaaatctgagtagaagacccttgccagcttccattgccactgccaatacctacagtccttataacaagagaattccacaatcctttcaagccatgagcccaattgggagaactgtggggattatactaaattagcagtacaaggtgtgcactctccaccccctgcccactccctatgagccaggctgctgcagcatggtgccatcttgagaccagagtcacctctggtgtgcaccctgctctgggagccactagccactgtgcctcacaagcactgggactccatcttcatcccaccaagcccataggtcattgaaccccacaacctcatctgtgcagagcctgggcccaagatcagctatgactcctgcactacagggaaaccaactcctgctgccttacctccagctgaaggaacagtctgattgtctcatccagggtgaacccccccttaagctggcgaaaacactacatgccatccttcaaacaggagaaactttcaagcttccgtgtagctgacatatccctgagtcagtggaatgactataggccatactcagaacctgagaaacaatgtagcagtgccactgccccaagcagacacaccccttgtctgcccaatggccctaatgatagggacaggagatagcgaaatactgggtagaagagggtggttccctggcaaaggccccaccctcaagcctggaaacccatggccctaaatgggaacaggcattcctatttttgcacccaaaagttcccttttggcccaccacactctgcatcctgaacccatataaaccccaaatcccaggctccacgagcagatgaacagaagagcagaagagcagcagagaaggagagaagagaaggagcatctgaacgttgagaggagttcagctgggaatgattggagatgagatcggcgctagatggccaaactccaggggaagatcatcttcccactccatcccctttccagctccccatccatcctgttgagagccacctccaccaatcaataaaaccctcgcattcaccatccttcaagtccgtgtgtgacctgatttttcctggatgctggacaagagctcaggatacagaaagcccttgcaaaaaggcagagtgttcactgagctgtttaacacttaagctgtccatggacagcaaagctaaaagagtgcgctgtaacacatgctcactgggacttcaggagtcgcagacacccacccctagattctattgtggggccggagcccaaaagtgctcacaccagcttctgcacctgcccatctgcatgctccccgtcatgtaaggggtttgagtgccagtaagccatcatccttttacttatttaacatttaatatgtatatggtgttggtgcatgataacatcatggaccagatataatgtttgtctccaaagagcttgtatagctatagggaaataagacttagacactgggcagagggaggtaaaactgacaatgagttgtgggatattacagataggaaagaacataggtgtggtgttttcatttttgtctgcaggttacaaagctatgcataaagaatagtaggaatagtcttctgctcattatattgacaaatgtgatttttaaaaagccaaggtaaattgatgtatttttagaaacatgaaaaatacttacaaaaatacttttaacatttaaaaaaatattgctagcataaagaaagtgggagagtggtccttctggccaaaaatgccatttgacttcttgtcatgcagccactggctacattttttataccttttctgaccctccagtttccacttctgtcactacatttttccatttctaatatcacactgcatgctgatttttgacttttggaactgatggcattttcaccctataaaagtgtcataaagacacattaatattcaaatgatcacttattttgtaaatagggaatttttgcatatattaaaccagtagctttcacttcacttcacataagtcatgtttctttgtggttgtccattttcaaatctgtgccacaagactatgtactgggaaggagaaaatgagaattaccacaaacaaaaaaaaaaagtgatagactctgaatcagagttcactttcttgacctctctagtgagataatagtcttgaaaggcaggcttcgtggaaagagaaatttcttttcattgttttattttttccaaatctattttttaaaacttttctatttagaaataattttagactcaaaggaaagttgcagaaatcagagttcctgcataccctttaacagcttcccccagtgttaacattttacattaccatagtaagagtatgaaaaccaggaaattaacagtgacataaaactgtcaccttatctatgaatctttatccagtttcaccagatttcctattaaagtgtttttcttgtcaaggatccaatccaggctcccacattgcatttggttgtattgtctccttggttttgtccaatattagacccaccttgagtctttcctttctttcttttcttttttttaaatttcatggctaacacacttaaagagaactggtcagttatttatagaatatcccttaatttggaatggtctttcttttaattattacattgaggttgtgccattttggcaagaatgccactgaagcgatgtgcccatcttagctcatcatatcagtgggcacatgatgtcgatatgccttattactggtgatgttagcctgtgtcactcaattaaggtgatgtctgccaggtttctcaattatgaagccactatttttcccttgacaatcactgaatatcttctggggagatacttgaagactatgcaaatatttcacttcttgccatatttttgcacactaatttgagcagccattgattgttcttgcctgcaacatttattactgtgctgttgcctaatggttattttttattttccctacttctaaatttattcattggtaatccattgtaagaagttgtcccttctccctcatttacttatttattcaattatttgtttacattagcatgaactcatgggtcatcatttgatactatcataacttactttgttgctcaaatttaactagctctggtctttgggagatccttcatgttgcttctctgtcttttcaacatgtccccagatttttttgagtacattctcacttggcaacatgagttttcctggattgtcttttatttcccttgccctagctctggaatcaccatttccctggagttaattctgtagccttgatttcttttattcaggaatggtatttacagctaagatctgggcagatatgctattgctataaggggttattgaaacaggaaatcttccctgaccccttcacaggacttgtgaagggggtaattcatttactgagcccacagctctcaatccctcatgggatggggagcatgcaggtgagtgggtacaggggctggcatgagtgcttctgggcactggcaggaacagaacttcgtgtggccctgtagcagcatctgcagggggtacctgtgacccatggagccttagaaggtgtgtgttacagttgtgctcttttagctttgccctctggtgatggcttaagtgtttaacagctcagtgtgacagccctctgtatcctgagctcttgtttggtgtccaggaagaagcaagttgcatgaacgaattgaggatgctaaatgcaggggattttgttgccgatgaaagtggctctcagtataatggagagctggaaaggggatggagtgggaaggtggttttccctggagtacagccatcctgggccaaactcttctctgagatcccaccatcaagccgtccctctgaaatcaagctgcttctcctcaacatcaagctgctttttctcttctttcctttgctgttgccagtggagcctggggtttttatgggtacacgatagggggtggaaaaggcaacattcaagagggaaaacaggaatgcatgttctcactttgggctgaggttccaggcttgagggtggggcttcaacagggaccccaccctcttctacccactattttccctgcctcctgtccatatcagtattgtctctagtcctgctcagtcaacagaagtaggatatatatacatccatccgtaagtatacatattaaaaattatacatttatacctctgattccaacccaacaccactggtttcattctagcctttctgttctttgtaacttcttttgctgatagtgaggaactagctcattatatttacttaagttttgatcctagtatatacacaaactagttttggaataatcaacctacattagcctagaatacagaatttgggttcaatttttttttgtcattagccttacagtattcatgcaaaatactcttttccaaagatatttagattagttctttcttcaccactctcttcactttgattatgttagttatttgtgatatagttaggttcatttgtcactgtttgtcttccatttgaggttcctatcacatcctggtttatttttaattatttatcgtgtgtgtgtgtgtgtgtgtgtgtgtgtgaaccattaccatggttctaagaatcagaactatgaaaaaaaaagtattctcagagaaacatttcttccgcattcggccttgtcctattgttctttccaccctgttctcactcaccccctctaggtaaccaatctcattaacttctggtttatctttcctgtgtttattttgcatttgtacaaatgagcagatatgtgtatattttctttctccttttatacacaaaggttagcactatagataatcttttttactttgcttttttgtaaaaaaataataacagtatatcctggaaatcacagacattttccatattcttttttactgctgcatagtgctccattgtatgaaggtaacttcatttatccaacaactgtcctctgtataataattttggttgcttccaatttttttgcaattacaaacaatgctgcaatgactaaccttggacatattcgtctgtgtgtgtgtatgattgggggtgtatctgcagggtagatttctagaagtgagattgcaggcccaaaaggtaagtgcatgtgtagttttgttaggttttgccaaaattccctccagaaagcttctaccagtttgcattgtgtgaaattatctatttccttatagcctcctgacagaatatatcctcacacttttttattttttctgatataagaagtacaacatggtatcacagtattgttttgattttatttctgtaattataagtgaatttgaacgttctaaccttttaaaaacatttctgttcatgtattttgccgtcttgctatgaggtttttgtcctttgtctcataacactttgatatattttctcccggtttgtccgttgtcatttgactctatttactcttggtatgtaatttaaaaaacatttttgtagtcaaaatttttttttattttattgcttctggattttgaattatagttagaaagcctttctcatatctaggttgaaaagcaatccccccgtgcttttttctaggatttttatggttccgtcccttgttttctatttagattcctaatcctcttggagcacatttttgtttatggtgtaagttacagatctaattttatcttttttccccagtggatgcccaattgtttgagcactatttattattataaagtccatctttgaggccaggcacagtggctcacacctgtaatctcagcattttgggaggccagggtttgaggattgcttgagtccaggagttcaagaccagcctgggcagcatggtgaaaccccgtctctactaaaaatacaaaaattaggtgggcatcatggtgcaggcctgtaatcccagctactcaggaggtggagccacaagaatcgcttgaacctgggaggcagaggttgcagtgagctgaggtggtgccactgcactccagcctgggcgacagagtgaaactctgtctcaaaataaaaaataaaataaaataaaataaataaaataaagtccatctttgtaccagtcatttgagatcccacctttatcacatattacatttccagattaacttgtgtctatttctaagctttctattctattccactggtctatttgtttattcttgtactagcaccacacttttaattatagagaatttatagtatgttttaattcctgatatatgacttatccccaaattgatttttcttttgagtgtgtcctggctactgttatgtgtttgtttttctatatgaactgtaatattagcttgtctaacttcatgaagaagcttgttggtattttctttgagactgtcctaaatatataaattgatttagggagagctgacatatttataatattgagttgcattattcaagaacagaagatgtctttccatttgttcaagtctacctgtctattcttgatacttcatgtctttcaaaaatgcttcttgtctattcttgactctttactcttccatatgcattagaattaacttgtcaagttctgttaaaaacttgttgattgaaattacattaaatttatagattaacttgatgataactgagatctttatgattttaaactttctaattcatgaataaatatatatcttcatttatttcacttttcttttagtcttaaatatatttttataatttttataataataaaaaatatatttttataattttccttcatagagtcttgtatatctattgctagattattcctaggtccttatttgcatttgctttttgttgttgttattgtaaatggaatctattttaaaattacattttcctaattgtggctgatgtataagaacgttatttatatatgcatgttgatattttaatccatcagcattgctgaactcacatcatctatgaataattacagtcctgtttctttcttcccaatcctttactccttttatgccttgtcttattgtgctgtttaatatcctttagaacaaaattaaatagaagtgattataatgggtattcttcctttgttcagaacttaaacaggagtatttctgaatttcatcatgcagtataatatttgctgtacagttttggttgataacctttattagtttaagaaagttcccttctttttttgttagctatcagtttaatcatgaaaaggttattgaagtctacaaaatatttgttctgcatgtattgaaatgtgtatatattttctctctttatataaaattgtgtttttaaataattatattatagttgtgagttattaataattttaaatatattaacatatgttaatgtaattaaatacaatgctggaatccatttgctaatattttatttaaagttttttgtctttgctttggaatgtgattggcctttcagttttgtctgtttattagaatcaaggtatatctgcctcatgaaaggtatgtgtttgtttgtttttcctttctattctctgaaagagttttggattatctattcctttagtgtatggtagaacactcctaaaaaacttttgggctggtgttttttaatgggtagattttaattactgattcagtttctttggttgttcaatagtttattcagattttctgtttcttttttgagttagttttggttctacatttgttttgaagaaattgcctgttttacttattttctaattaatttgtaatatagttgttcaaagcattattttatgattgttaaatatcaaccgtatttgtaactatgtcttcttttgttcacagcacctttttttttttttttgtctgagtcccactctgtcgcccatgctggagtgcagtggcgcgatctcggctcactgcaaactccacctcctgggttcaggtgattctctcacctcagcctcctgagtagctgttcacagaaccttttattcttactctttcattaaaaatcttgctaaaagtttgtcaattttcaatgaaacaaatttaggattgtgatacttgctattgtttcattgtctttagttcattgattttcagtcatatctttatcattttcttccctctattcaacttgcctatcgtggatacgtttttttttttttttttcccttctaatttcttgggttgtatgtttggctcattaattttcaactcctttatgtcaaaggcaggattttaagacaataaattttcctttaactgtaactatagctgcacctcacacatttttacaaatagtttcagttacaactcagtactagatattttttaatgtctgttatcatttatttcctgtttaattaatgatttacctaaaagcattttcaaaaacttattgccataaatgtattcagtctttttccttttctaatagcttgaaactagaagttgaataagatcttgcccagaaaaaaagcatgtttttaaatccccaaatttatagagttctttttgctttttaaaagattattgatttataacttaatagcattatggttgatgacttggtttatatgatatcagttctttgctatatgttgagatgtgttttgtggcctaaaatgtggtcaatttctgcaaacgtacaatgtgcacttaaacagaacatacattctttttttattaggtacggaaatccatatatgtcaatttatataagtggttccaatccttttaatgacatctcatatatagaaaattctaatatttgtacagcacagtagcataagttggagttgatttgaaaatgtcttgcagggcttactaaaatatttattgtaccttttaaaattttatataattacaaggaaaaatacaaagtattagataagacattgttaaatttttataagcctaaataaaacactttcagaattttacttgagaaacttgagtttgctttcatgaacataactattttaatcagattttatgtttgaaatagctatagatcattcctgattaagatgttttaataatgaccttttctaatctcctcaaattcatggtgttgaaaacccaatgaaaatatttgtccaaataaattaccaaaatcatgttacaacattttaaaaacaattcaaaccgttgatattatataggaagcatctaaagttcttccttaatttcactgaaaaaatgtaatttgaaatttcttgtgacagggcatggtagctttgtaacgtgtccacttggctagttgaactgtgtctcccagaagccctttccctatgtgttttcagtcaggatgggcttcaggaggcatttttgcatgagatttggagggcagaagtgaagcagaagccattctgctttgtatgctgggaaggttggagcaagggcgttttaaggctcacacgtgttgctttatctgtcggctcacctcatttgcttagggtagcatctgggctggaactgctgcaccttcccttaaatctaactttggcttctccagttcctgagccaggtgtgtgtttatgtgtttagctctgggaaaaagggcattagtgtctcctgcaggacactcacttcatcaaggctggagacagcaagaactgacactggttccaggccatccttgtaggttacatcttgaccttaatctctcctatttatatgcaccttgcctgctcttgggtttcaaatccagcattagacgcaaaaataatagcgtaatagaaactgttcaaccacagcaaagcacggtggctcacgcctgtaatctcagcactttgggaggccgaggtgggtgtctcttgaccgaggtggtcaagagttcgagaccagcctggctaacatggcgaaaccctgtctctttactaaaaatacaaaaaattagccaggcgtggtagtgggtgccaatcgtcttaactactcaggaggctgaggcaggataatcacttgaacctgggaggcagaggttgcaatgagcagagattgcaccattgcactctatttagcctgggcaacaagagcaaaactctgtctcgaaaaaaaaaaaaaaagattgtttaatcagctcccacagttgcataaggtgaaatccttgtctgtctatctatctatctatctatctatctatctatctatcatctattaatcatctgtctttttctctatctagctatttggatgtctggccatcttatccccataaagttccgcttctctgtctgaactctgacttatacacaggacaaataaatttcaaatccaaataaaatttcacataccaagtatttttaaattctagtgaagttttactgtgaaaatctactgttagaacagttacctctagcttgcaggccattcaagttcatattagtcacaaacagaaaaaagcatcaatggtggattaaagaaaactgcaaattctttgatatttttcccatttagaggcggggtctactttcccttttcttgaatctaggctgacctgtgactgcttcggccaactgaatagggaagagtgatgctgtgctgtttccaggcctgttctttaaaagtacttggaagcttctgccttggcctctttgtgcctgagttgctgtataagaatctgactaccttgctggagagaccttgtggagaagacttgaccttatatgcagaggtagaggggccctggttagtccagccatctagccatcctgtcaaaatagcaggtatgtgagaaaagctgtcttgattcctccagcccagcccagccaccaactgaataataccaagtatatgtacctcaaatggaggaaaagaactgctcagctaagtcctgcccaacgtcctgactcagaagataatgacagataatgaaatgattgttgttttaagccactgtgttttgaggtagtttattacacagcaatggatgacagaatagtatttatatatatatatatatataaatatatataaatatatatatttatataaatttatatatatttatatatatatatgtaaagacaggtatttgggaccaatgcctggattagcacttaccaggagtcccctttccccatctctccatcccatgctgcagtttgggttgtattccttgctcctcagtcacctggagcatccattcccctggagctccatgagccctttggactcaagagggcaggggtttgccctgcagtgcctgctgaagtacatctccaggtagtagagcaccttggccatgcacagtgcatctggcagagcagtgagggctccattttgctcattgcactcaacatctccagggactgtggggttccctgtcagaccttgctcttctccatcctccctccaaggagccttggataaggcttctaacagcctggaggctccaggcagccaggccctgccagactgccctgagggccaaggggattaatatctcacagcacatctgtaactgattcttggcattccagggagtctggcacaactgtgagcagctctgaattaaatcaagcttcttaatttgtgcagctcaatttttttttttatttatttttttgagagggagtcttgctctgtcgcccaggctggagtgcagtagcgcgatctcggctcattgcaagctccgcctcctgggttcacgccattcttctgcctcagcttcccgagtagctgggactacaggcgtccaccaccacgcccggctaattttttgtatttttagggagacggagtttcaccatggtctcgatctcctgaccctgtgatccgcccgccttggcctcccaaagtgctgggattacaggcgtgggccaccggcgcccggctggctcaaatttttaaaattcttactaattttttatttgctagatcaccccctttctatcttgtcctttattatccatttaatcctatcctttttttgaaaccctaacagtcattattgttgtgctaatcagctgcctttgctttcagatccatttcctgcccttcttttattctactctgtattacagccaaccacatttccaggctcccttgtcctctgctatctaggtgagttttgtcagtggaagacattggtggaaggttggatgcttcttcttctagcatctctggtggtggctgtgtttcctccctgactccagctcccactgggtgtcattcactttgtggttttggtgcttgcccaatggcctggcttctgagccctgcttctgcagcccagggagagtagcagcagtctgctgtttttagtgtctgggttgccactcttttcctgtttgacctctctgggcttccatgacccacataagtcattaaattccctctgtcaaaaagacttaggttcctgtttcatgactggatgctgactgatattgttattaccattgtaactattatcgttgttattgtttttattattttatactgccaatgcctgtttaaatttacccatgtgttttcaaattactttgatcaccttgcattttgcattccacttctatacttttggttaaagttttcttctttttgcaacatatccctagcatttatttctataaaggtctgtgttttagataacttacagattcaaaattttaaaatatggctttttgtcatttacttaagatctgtatgcaagaagaaatgaaaaagatgaacaggtagagtccaggactacctaccacagctcaggtcaacattaattttatgatttaattaattccataaattctcttttctgtatgaatataaggttcctccctccctgtactcacacatctacctcttctaggagttgccttgggatccacaaagaaattgaggtggtccagtactcataagccaacaaacttcaaaggagagtcaaatgtacattttcaaaataagagtactgaaaagcattgaaataaacacacaaaaagagattcaaatgtacatcttaaaaggaggaggagattctttgaagaagtaggggaatatgacgttgaaagtctctgaagaggttgtgatagttgtttaagggagtagaacattaaaacatttttgtctgttcaatcttaatttttaaaaatgatagcatagagtttggccaattatggaggggctgatttcatcactatcaatgagcagtaaactttcttggtcttttatttggggaatgtatttattttactttcacttttgaatgagacttagctgatgcaatggactgaattgtgttcctccagaatttgtatgttgaagctgtaagggcaaatgtgactgtatttggaggcagggcctttaaagaggtaattaaggttaactaaggtcataaagatggggcctaacccaatatcactgtccttataagaagagacacccgggatgcatttgcacagagaaaaggccccaggaagacactgcaagaagagggtgctcttcaagtcagggagaaaccaaacctactaacactttgatctttgacttctgggctccgtaactgtgaaaaataagcttctgttgtttaagccacctaatttgaggtattttgttatggcagccctagaaaactaaatacagctgggtatagaattctaggttgatgattttgcttttatagtatttttataatattttgagatgtgtgtctttgaagttctgcagttgcattatattgtggcttgctttggatttgttacatttaagctttatttatccttcctggaattcattacagtttttgaacttcaggattcaagtgttttaatcattgatgaaaacatttcaaccattatctcttcaagtattgcctgtcttattttcctctatttcgcattcttggaattaaatctgttggttctccttttccgtcttccatgtcccttaatcttccatattttccagatctttatatctctgtgcctattgagtaatgtctaaaatctgttttccagtttataaattatcttgctatatcaaatctgctatttaacctactcatttaagttttcaatttccttgacatatacctatgtgaatgggtgggtttttacttagactaccttttcatgtagaatatgtagactaccttttcatgtagaacctagcttctatgcaaggttctcaattccaatttcctgtccacttgggcccagtgcttacctcatgtttccacatgagcgtgaaatcacaagcccttgggtgaacagaatcagtaatcactggtcgggtgcagtggctcatgcctgtaatcccagcactttgggaggctgaggtaggcggatcatgaggtcaggagtttgagaccagcttggccaacatggtgaaatcctgtctctactaaaaatacaaaaaaaaaaaaaaagtaaataaataaaattagctgagcatggtggcatgcgcctgtaatcccagctacttgggaggctgaggcaagagaattgcttgaacccagcaggtggagattgcaatgagccgagatcaccccactgcactccagcctgggtgacagagcgagactccatctcaaaaaaattaataaataataataatagtcacccttccacctccatagcacagctacgtcatgaactgacaccttaaaactttgttctgttttcaattatctcttggtttctgatgcctgggtatttctttttctttcttgagagcttaagcatgaatataaaacatttcaaattttatattttatccagtatttctagctttttaatagtgagatttatcttactctcccattttattaaaacagaaagtcttgagtaacattttaatactgagaaaaaaagcctcattattagttttagaaaaagagagacaatctgtgttgttctggaaccaagacaaagttctagaagattctctcttgatccttaaacagcatagaaaaaccaggtaagttgactatgttcacgtttaggagtatgatggccaatggatccaaaacctatcctatatctacatgttggtggccacattaatctgacatctgacagcaagagcgatgattgggttcactggaaatctttgtgaagtacgagtgaagtccttgtgaagtcagagtaagtatcagaactttgagttctagtcttggctctagactgattcaaaaggtcagggcctaatcaatttactcattaacttataattgtaattaattagattttattaatacaagaataaaagaattgtccagcacctactaagccaaatcctagagatatggagaagcagataaaagttgctgctttcaaagaacacagttcactaataggagactggcttggaatcatctattctataagtgaaattttgatggattattgttgaggtgcaaaggatggagcagtcagttgaatcttgctgggggaattgtaatcagaaagctccgagaatagtaaacgagagttttggaggcctaagatcttggaatcacatgtgtagaaggatatttaaggtgtgcaggctcctccatgagtagccccaatgccttgagtggaatggatgcaaaggtacggacttcttgcatccttcccaggatatcaggaggcttagagcaatatctgcaaaatgttggcgattgctgaaacgcagcgctacagcatccatggggtcttgcccttcttcaaccattcagtaaatagcactcagtagagattctggctgaggatgcttgttttcaaaacaacagccctgagccaacctttttaagtagttccatatgtttttatggagagtttatggattgtggccttcggaattcttttgtttatcactgggaattcaagtcctgaaagctgctaactaaccatgaggtctgctggttatacaagctgttggacctcttaaggacgttgacataaggaccactttctgtgaaataagaattagtggtttaaaaagagtgcacttaacagtatcatgtaagtatcagtttctgtatgtcattactagccaggctttttttaaaaaactggactgtgctgccttgtgtgtacatttaaatgaggcccttaaagggaaatctgagcaatgtcttcaaacaaagacttataatcagaagggtctttttaaaaaaaaaaaaaaaaaagaataactatcttcagcagacctaaaaccaggatggaaaggtggatacttccccacctgggccccaaagcagggcccttcaaaatactgaaggtccagcattccctgggcaattcttcctccttctctgtcctccccacccccatcaatacccagcttgcagtgatattcttttaccctttactaatctaatgccaaacacatgtaggttctatcctgtttccaggaaagaggtttccatgaattgcctcatcagccttactaatagctacaatatatggagcactttgtgcccagcactcgattccttttatacttgatctcttttcatcctttcttcacaatagccccatgaggtgggtgctataattatttctaattttacagataaggaaaccaaagctcagagagtctgagcaatttgcttaaagttgcttaacagctgtattagcctactacttataattcgactacctgtgtccaaggctacataaattcaggtcgcctgactcaaagctcttattcaacgtgctagcctccttcccactagatctcataagatctagcttgatctctaaggctccattccagcttggaagaactatggttcttctccagtgtcagttgtgttgctgttcatgttgttttcatgtaaaacaatgtaagaaagaggctgataatctccctccatgaaacagttcttcacacatttaaaatcatccatggctgatcataaatgcttctccagagagtgaatggtcatggctggtgcagaagggtaacactctggaaaggcggatgtgagacctggcagctctgcctgggtacacatagcttagggctgacaagtgagtcagcagaagtgagcagacaatactgcattgggttttaacgtgatgagtcagccttgctatctggccagcttcagtgcagccccctgaagttttaacagaatattaattgccctttcacttcccattccacacagctgggtgggattgctaccagccacactgttgagaagttacacattttagcccagcctagaaaggtttcctgtggtgggtgaaatgacaacatgcacaaaggtcaaactccagatgtgggaatctgaccttttctcctcttggggaaaacattgcctcattataatctcaaaagatttttggtacaggtttaaggctagagtctactgaaagatccaaactcctctaacatagaggatgccagcctgtttcatgtaaatttatccaaggctttgagaccacctacaaaattcctgagccaagggaccagggaatgtaggcgaatgtttaggcatttctgaaggagggagctagacctagaagttgctgcttgctcctagaagttggaaggcatttcaagatgaggaatgagttgtttctggattgatgccttcactggctagaaatgccagcgggtggtgggaagagtacatggcaggatgatgaggagtttcgcattcattcattcatttattcatctgtgtattcattttacaaaaattcatatcagatttgcaaaattcactcacaatacactcagagataataaaaaatgtaacaactttttttattaactggtggaatatttctctcaaatttccaccactggaccccagagtgggaattcaattttagcccaatcttgtaaacttagttccaatgtaattatctaggttgagctaaaagtttcttttcatctttcaggtttcctcttcatgcctctactcctatgcagtttgacctctcagtgtgcagctggtgatagatggaaacccttgttcataagctttgtggcactgtcggcaggatgaggggacttctggatcctcactggtcactgtggcagagtggttggtgttgtctgctccctagacaggaacccactgaagaatctgacattttttgatatgctggcattcattgttacagcccatcatcccagccatcaatccaggacatggggtctgtgcccacggtgggaaggaggagggggaagctggctttgttctgacgttgggcttcttctgctccaccagtactttctgtgggggaaataggtaaagaaatggctgttcagatgagaagatgtgtcagtaaacttttgctacagtgatgctgcaaaacaaatcactggtgactttcagtggcacacagcaataaacatttatttagctcagggattgacaatctttttttttttttaaagggccaaatagtaaatattttaggtgtttcaggccatacagtctctgaactctgaacttgtagcacaacagtagccttagatgctatgcaaatggaggagcatgactgtgttccaataaaactttatttatggacact

SEQ ID NO: 256 - DNA, 173910 bp, Homo sapiens
gagaacatcttgttggttcttagttattaaagtatttgatcacattttagaaattctgataactttgggcaagctgacaggacatagtttgagatggcgatagaacatattgtgaattacagccttggatacagaatagcattggaactgatttaatcgataaattgttctgacccattcagggcattttggggacagactctacagtttactagtggccccaggacatcctgcaaaagaggtgaaatcagtattggagaagtggtctcatgaagatgggagcacgactactacaattgactgctgacttctcacccaaggaagtaactgtatcccagcctaatctcagtggataagcccacagggttaaggtaatggtcttcatacttttgctgacacacccctaaaatagtttttaagttgacatgtaaaatattttgaccttagtggcaaaacatgtaattttttgcgtaatataaatgtgaatattttaaaataaaaagggttatgttacctaaaatgcaatctaaatgaaatctaaatccatagaaaaggaatactcaccatcatttattttcacagaaattttacattatgccttttcctatttgaatttgtattttcattctacttccctaacataattttattttaatgtattttgtgcccaaatatattttattgcttactctattattcttttccacaataataagttgtttataggctgggcatggtggctcatgcctgtaatcccagcactttgggaggctgaggtgggtggatcatctgagctcaggagttccagatcagcctggccaacatggtgaaacccctgtctctactaaaattagctgggtgtggtggtggacacctgtaatcccagctacttgggaggctgaggcaggagaatcacttgaacctgggaggtggaggttgcagtgagctgagatcatgtcattgcactccagcgtggatgacaagagtgagactcttatctcaaaaaaaatagtttgtaatttaaaaaaattcctatgactataaggttctaaatgtcagaaatttcttttgaatggagttatcattacaattattgttagtacataataatcataactacattataaatttttacaaataattactaaagagaactaaaattttattggaaatatatctctcaacgaagtgaatggagctcccttctcaattacttcatgtatttataggtaaatgtaactttttgctaggcaacaaaatgggaaaatatgttgggtgataattaggtatagggcttacacaagcaaataaatgattgttgttaaatgtgttgtttaaaatagaaaacaatatatctaaatctaagtctattacatgaatggtaggaatgaataatgaggtgagaaatgtttaacaaataacactgagcagacatattttggtaaaaaaatgaatatagatttactgtattcaataatcttttggcaaaaattaattagaatattttcttctaagatctgaatatctattaaagaaaatgagaaacattaactttctagttatatatgttcctttttcatgtaacattgatatattgaaaggaaatttggaattttttacattcttttccttgaaatcatttggaatttgcatctgagacacaggagaatgagattttacatcaaatgctctcattccggagtaagtgtgccttgtagctaattggtatttcccagaatgattttcacaaatcttgcatatccaaattctgagatgtatatgtggagcatggaacctgactgtgagtttgttatctggatgaagtagggtacaacctcctttagtatttttgtttgctctctcacccgcgttctttgacatcatcaggaaatggaagaggaaatggcattggacaaaaattagcacagcacccgcccttgtcccagtgtatgtatactcagaacacctcaacatagaccaaaatacccaatttctagcaccaggctcttctcttaactgaaatatatataaggaaagccaggaaatcctcatgtaggtttcttataccctgattaaatcaaattttgatttcaagacagtatttggaattgttcctttgtatgatgccttagaggtttttttgcacaccagagcaatttgctatagaaggatctgggatggataagaagatgcctgtcttttataagcgggaaaagaatgattttttttttttttttttacttgtcactgacttgaagcttaaagaatgatttttaaaaggagttgtaaaaatagaattgatgtgacatctcaacctcagtcatatttcaggcagctcaattttgggaaagaataggtgaaagttgaataaatggaatagatttccttaaaatttcctatgtctgtattctccttagaaagtacccatggaatcacagggtagacttatgccagagtgaagactactaaattaagagaataaaattgagtggggaatgtgatgtagttacagggggtgctgttaacactcctggcctcttgggtcaccccttcctcttctccatgaagtaagatacctgatggtgagaaactgtgagaaaccttggcctctttggccagtcttactcttggggccaggcttctctcaggaatcatgccttctggcctatttctttgggctgcagattttacagggataggcctgtggagtgaggggaggggaggattgcagttgccctgcactaccggttagcacctcagtgtaagcctgcctcatcctacagtttggtgttgggaggcccattgttgccatgcaatctccagcatcagctttatcagtagccgtggtagtttttggctgtctactcttttgtgttagactgaattatttacagatctgtgaaacatatacaaaatattgacaagctgtacttcgttttgatactgagtgaaagttctccagtagaacaactgacttttagcagcatgcaggtgcagaaatttctgatgagaagaaccaaaagatcataactttgattctttattttctctcctctccagtatccaatgcagtctctcaggtggtttataccttggtgggaaagaggagtgtggtttactcccaagccctaaatactctcagttcttaacagtactgtgcatattaatacaataagtactgtgaattttcctaaggtcactttggctatgaggatatgttcaatcctgctttttccctttaataatattttatatacatttcatagatttgtacatagtaattatattttcaaaatgttgttttgtaagagtctgttactgggacatatatataaagcatcaaaagagttaggttcaggagaaagaaaattgctctacagccttaaacagttagttctttgagattcactattgccggagtttcacagaagatgaatgaatacattaaggtttgactctaaggaagtcagcttgccattctgtttcttcctgtgctgtaagcagcctggcttgctaagccttggttttaacattcataaaactatgatatgaaacacggccatcatatgagaaaataagactaaaaagcaaaataaagacgtgattactgtaatagaagctatgtgcctatagatctctaatatagaaatggtgctttttaaagggggtacaaatcgatgttgttttataagtacttgggtctttagaaaatgcaatctgcttttcagattgcaaaaaacaaacaaacaaaaaaacccctcagaagctaagagccttagtttaatgcaaaataaactgtttttgactcctctataataaattggcacacataattcgagtattgtcatgcagaagcagaaattttgactagctttacattgttatggttgctgaatgaaagatctgcagtagaacaactgacttttagcagcatgcaggtgtagaaatttctgatgagagaaccaagagatcaaaactttgattcttctttttctcttctttccagtatccaactgtcaagttccactggccttccaatatattgtcccaaatctgactgaccaccttccatgtttatagctactatcctagtgcacgccatcagcagctatcatctgaaccatgacaacagcttcttgactggcgtcttggtttccactcttgccttcccagagttcattctctgttattagccatttaacaatataaatcagacctaccacttcccttcctatacttcactaatgtctttgccttgcaattagaataaaatccaaactctttatcatggcctatatgacctattctataccttccctttgattgctctcaaatcgccttccttgctcattatgatccagtcatattgattttctgtctttgcttgaatactccaacctcattcctaacttagagattttgcatttgatcttcctctgggtctggaattctctaccccatttctcatggctgacttgttctcatcactgaagtctcagctcaaatattctctcctctgagaagccttatcctgaccacctgtctaaagagctctcacatcctctcccccaactttaatcattctctatcctgcttaattttcttcatagcatttagcactacctgaaattatcttattttttacatgtttattatctgtctgtctgttagcccctagtagaatgtggaatgtgatttcacggtggtagagcttttactgtcttgtttcctgctctatcctcaaagcttagaacaaaggttggcatttggtggggattactaaatatttgctgaataaatgaataaatcaaggccctgatgtacccagaaaaggcctttcaaggggctttgatcatactaatttttcatggttcagagttgtggcctttcattttgaatgctaagaaatctgcttttgccagcacatggaaattttttttctccaggaaagaactttcatgaactgagttgcaagagtgacatataaaatccctaagccaatttattagtttctggtgagcagtataactgtcacatggactcagagttgcaccaacatgatgtgttgaaaaatctctgcctatgggctgacatataaaggatagtgaattgaatcagaaagctttttgaaaaacattgaatactagaaagggaaattagttagatggctcatatatttaaaagcattcatttatttcacaaatatttcaagatctctatcttttgtgtggtgtgctaggtattgaggagtcaacagggaatcatatcaagtaccagtccttaaagatttgcagtctagttggggaggctaacaataagctgacaattataaatcaatgtcaaaatatttttttaggataatcttagggtaatatgggaggatttagatgggaaactgagccttagggaattgaggtgaactctgaggagttagtgcagcatgaggagaaagagcactgtgtgcagaagctgtgacctgaaccaaggtgtggacccggagagggcagagttttctaagaaacacaggtagctgagtgcggcggtagtgaagagctgtagggtgaggtgagaaggctgcagataaggctcatggacttaggcttggactttatccctacatagagtaaagaggagccactgaaagttttgtttcagtggggaggtagaatctattttttaggttgccggagcacagctgatattttgcattcctttcttcctaagaactttccatgaatatctggctaaagtctacactccctcccttgaacacatgacccttcctttatatgtactctccagccttatatcctactgctttgcagcacatgatctgtgctccagacacaccaaacttcctggtttccagattcactcccgtctttaattatgcctttgtatcccctgcacttgtgaagcatgctcgtctaccccacttccaaaaaatgttactgaatcatttttccaaatgacggaagtaagacatgttctttgtaacaagccaaaggacagagagatgtggaaagaaaaaattaaaactttctcctttcctctcaccaccaccaccaccaccaccaccatacccatacacacagagtccactgtataaaacagtttttttttaacttaaatagattcatgctattcattttgtgcagtctctccgtctcccaacagaatctcatggacatcactctagcacctgctgggtgccaggccctgtgcctcacctcatttaccctacaactaccatggcactattgtccccagtgggtagacaaggaactgacatgtgattaatttgcccaaagttgcacagctagtgattgtgggagcagcagctggaacttgggcaatctggcttttgagtccaaagtgctaccactgccttttactgtctcccaaattaatgctatttttgttctttttaataactttacaatattcgtatggatgtctggaatatattcaattatttctcttgttgatgaatgttgaggttattttttgccactgcacttctccaaggagggacttgagatcaaagaacatactatttttattaagcatggccaaattatattccaaggattatatagcccaagcaacatagaggcatatctgtttccttatattcctgccagtcctgggtgatgctgatatttttagttttttagtttgttcgtttgtttttttacccctggctgtgtgatcagtaaaaacaatacatctttattttgatttgcatgttttctgactacaggtgagattgtgaatttttctgcatgtttttgggatgtttgcatttcctgtttcatgatttgtccatgaatttcctctcctgtctattttttctgttgggttgtttgtccttgatcatttttggtggagggtatggtatatgtgtatgtggagggatgtttataatataataaataattttaaccctttttctcacataggttcaaatactttctccttgtctatattcattcaccttttgaatttgctatgggatcttttaccttatagaagtgtttactttttatgtggtcaaatctgttagtcttttccttttggctttcctggaattcacaggttttaggcatttctgttcattaaggattgggacacttggccaaggctctccctggaggtgcttgatgggctttgaaaacttttgtctcagactcttttacctttgtttctacttcccagtctccttctgagagatctgttctttcttggaatttgttattacattcaactagactaaagcaaagtatgtctgggctgggaatcatttgtcattgtaaaagtgtgtttgcatgtcttttctctgattcactatgttttaattttctgtttctctctccttgttttaaggagtaatcatcatgctccatttcgtttttgagccatcttcagcctttgagtccttaagctttttggagacagtttgtggagaaggtatgcccttgatacaaggcctatggatagtgatgacgattggttttgaggctgtggatttgagaatgagttagtctctgtctttgattataactgtataatcctgggaagttgtaataggtctccaggcccttttccataaaataataatactgctctgaagctactttttgacagtgcaggagaggactctaaccgttaatttaaatgtttcgtccttgttggtcgcatttcaagaatattttaatttcaagacttgtgcttacgccttcacaaattaccttggtgtacccctcttttcattcactgttagcccatgaaagaaggataaaatttgtttgccttaatgactggtgtcttttatagagtctctagaatgaactgcctatttcactgttgagaagagaaacatttaaactcttcgtggaagttaaatttggggtcattttacacaaaccatggctttggtccaaggaactgagatagatcatgtgagttgggagtggacaagggaaagagtctggcctgcattgtggtagatttttaaaaatttaaatctttatgtttaattgagaaataataattgtatatatttatggggcacaatgtgatgtttcgatatatgtatgcattatggaatgattataccaggtgagttaacatatccataacctcacatacttaccattattttctattgagaacatttaaaatatattcttttgacaaatttgatatataaaatacagtgctataactatgattaataatacataataataatgctactgtatgataaatttcaaaaaattattcctccgtctaaccagtctaactttgtatatcctttgaccaacatctcctcagccactccctagactcccagcctctggtaaccaccattctctacttttataagttcaacttttttatattccacatgcaagtaagattattcagtatttgtctttctatgcctggcttatttcacctagcatattttcttttggatatgtccactttcttttgtccattggtggacacttaggttgatttcataacttggctattgtgaacactgcagcaatgaacacgggagtgcagatatctctttgacatactgatttcaattcttgtggatatatgcctagaagtgggattgctggatcatatggtaattttatatttagttttttgaggaacctccatattgttttccgtagtgactttacttagtggattttgaaatgcacacagaatttgttccaggtttattaatgggctcatagaaaataaagcaagaagagacataaagttattacccaggtgtcccccatgccctcaggctggtgaataacaaaaccaatcagtgaaggcagtttgttgaattgctcagttgataatactcttggatggtagctaattttaggggatttggggataagtactaggattgagaagctaattggacaagtggatctcaggagaactcatggctgacccattgatctggttcattctttgcctcccatctccatgagatttgaggcagcatggcccccctgctcttagctgtggatctgttaggtaagaggagatgactacaccaactccttgcttaaaagtctttctgtcccttatcctcaggccttgaaagttttaggttgtatgcagaaattaaaatcaattaatatatttaaatgctatgtgcaagacattgtatgggatggtgtgtgtgtgtgtgtgtgtgtgtgtgtgtgtgtgtgtgtggaagagagaggagagagggagaaagagaagagagtgctgtattaggtaaggcagagttcttgcctccaaggagcagaggttgctaactcaattgcctaggaggccgggtagattcagtcagtcacatggctttgcatgtgtaagaaaaacaacagagttagccagataaatgacatcagattcttacttgtgtcactgacaataggaggtggtgggtgctatggcaaatgggagttgcacaccctatgtaaagagagcagcccatacaaagatctagcatagtggtgttcaaagtatgggtccctggacctgcagcatcagaatcacctggaaacctgttagaaatggaagattttcagccccgtctcagcccactgattcagaaactctaaacatgggagccttgcagtctctgctttaatacactttggcgatttgagaaccactgttgtaccatggtgttgccttgtgggaatttagatccagtgttgctagatcttttgatttttttcaagggaagctataaagctaaatccttatggaatctactgatttttaaatattagaagttgtacaggatatatgtaattttggggagcatgagaagtgggaagaggtaccctgtacaggccaaactgcaggctaaagaaaccacatctgtgagcctcgtggcctccaggcctccagtatgaacttagaataattaaatgtctgcttcattgttggactagagcaatgattttcagagagagagagaggagagagagagagagagagagagagagagagagagagagagagagtgagagtgagtagacttgaaaggcaaaagggggcttgtaaaggctgcacagaatctgatccttccagagcatccctcaggtatgttaataaggaaggaaagaagcccctgctatggctcttgagcactgtggattataaactgtgttcacatctgttctttcatcaggtcctcacaacattgtgcaacaagtgtgaaagatgtagtctccatttacggctactgaaataggctgagagagggtaagtgatttgcctaaggtcacatagcttgtgaggcttaaatctgagactagatacctaattctatgctttctaaactagagtttctctctcatacatagttatgtatatttatgtgtgtttgtgtatccaaacaccactaattcctgaaaagatctggtgtggctcactggtgactggtttttgtcctgttccttatgactgagcctcagctggtcccctccctggggtggtgtgctgcctcaggccccagattttcttccttttttcttctgtgaactccttagtaccagttgtccctcttggaacctttctcccacaccagttctgctcctggactctgactactcggggtcccagatttccctgttctggcctgtcttgccaccgaccgaacctcactgggacactggttctagatttgtcccctgtatgggtgatatgtgacccaggcatctgccatctgcaactagactgagtgtcctgactcattttccataggctgctgagctgccaccagagtaatggctttctgacatgtggcaagtttggataataaatgatgtatattattatattaggagagctagagtataggattctttcaagtattttacctcatctagcttaaaatgcaacaggcatgtatccagatagcactaccagaaaaattttagtagtttgaaatttctggggcctgttaaatatgatattgatgaattctgcattgtgctgggtatggggtgggcattgtgacagttttagatacagtcttttgaaggggctatttcttccatgttcggaaaccaagtgctggggagggatgatgggggagagctggtggttgctgagtgtccaggtgtttacaacaggaccctgcgtgtgcagtgaatcagaaactgttcagtcttctctttcctcgccctcaccccaaaccatccatgtaactgtctgtgtgttgaggggggtggtgttgggggtgggagagagatctagtgactatgaaagcactagggtgcagaaatgtcttggtacagcgctgctgtggatattgataggaggaaatagagaaggtaccttttgcaaggacctcacgtagcccagggttggcttctattagttagtttttttttttttttttttatcagagaataacagatcactagtgggaagggtgtgtttcagccttatcttggatgcttccttactttatttgacttaattcagaaactatgcaatagttttgtgtgacttttgccatttccttttcacgtaatgagttttatttaaagtcctcataaccgtttttttgttttgttttgttttctatggtaagagtaatcaaatgagaattgtaaacagttttggggccatttttactcgacaaaactgttctcctgagccagacctctttctttctctgaaacacttaggggcaggagaaccagacttttataggagaaatatgaattcttgtacattgtcacaaactggttaataaataatttaaaagcagaaagggtcctattgaaatattggactccaactttgtccagtagacatactgagtaccaaggatttctcagcttatttgaacaaatgtaggaagatatttaaaatttccctcagtgaccacatagaatgtcatttctctatctgcttcaacacagagctgttgggtagaaagtgaaggctgaaggtcacctggaataataacagtaacagcttatttatattgttttgtaccaaagctgttcatatatgtttgtgtgttgtgtgtgtacaggtatatccatatatatgtatacacacatacacactacacatgtatatatatatatggatatacctgtacacacacaacacacacacacacaaatacacctttaatcctcacaataatgtatgggtcaggtacaattattatcactattttacacatgtggaaactgaggcacaatgatgttaagccactcttctaagctcacacagctagaaactgatcatttgcatccaggcaatctataccatatcagttcccttgacatattcttgcaggactcactgaggatcaaagttctccaatcctggaacctgtgctaaagctaccccacaggctggttctgttgtgtgagacattgatgctatcactcaccaatctgcctagaccacagtagctgacatttactgagcacttactatgtgccaggtaatgtggaaagtactttgtatacatcatcttaccaaatcctcccagcagacttatgaagtaggggctgttttacatatgaggaaactgagacctgaagaagttaagtaacctgctcaagataaatgctagtaggtataggctcaagatttaccactatgctcttctgctctcttgctcaggagctgggctcctaactttgtgctcccagtaaggactctgctagtgcacattttctctgtgtcatgacttttgctaccagcctcctgaagtcaagggttaagggtgctttcgagaggagaaagcctggcttaacagggaatctggaagagaggtgacaggaactcttcccttcaatgggatctgagcagtgcgttatagtgagttcctgtgggggaagggcattgattgctaaaatgggagctcttaaatattcattatggttggttacattttggccttcactcttaacaattactatttgattccactttatttaatatatgacctttatttttcttttatttattcatttggccactgttgataccttgaatattttagctgcctactatagtcaaagagctctagcagaattacttgaaaatagaatcaattcatctaaattagccatcaatattatgttgtaaaagggataattatagtaatgccattatataaaatgaaagtataaatatatataatagattcaacatgagaataatagatgtttaattctggcatcttctctagatgtctcttatttcaacactccttaagctcctactctctgctagccaccctgggaggtgctgggattataaagataataagccatggaccttgtcttcaagggatatgcagtccctgctgggagacaattgataaagagctatgagaacactaagggcggatgcaacccagagcagaggaggtggggtggaaatgctggccaggaaggctacttggaggaggtgatcccagagcatttaatatttcacactggtgagagcaggaaggcttggtagctcagcacacggggtctggagtcaggggtgttcaaatcctggctctcttgcttgcagttaagtttgtttactgtggtgttgcagtttctcagctccattatactcttcttttttttttgagatggagttttgctcttgttgcccaggctggagtgcagtggtgtgattttgcctcactgcagcctccgcctcctgggttcaagtaattctcttgcctcagcctcccaagtagctgcgattataggtgctcgccaccatacctggctaatttttgtatttttagtagagaaggggttttaccatgttggctaggctggtctggaactcctgacctcaggtgatccacctgcctcagcctctcaaagtgttgggattacaggcatgagccaccacacctggcccattatactcttatggaaccactgttgtgtatgtgatctgttgttttactgaaacatgatgtggcagcacatgactgtagaaggaaatacaaccacaggagagggtgtttgggctaaggtgtcatgatgtcatggaagagtcttacccattgatgtccagagtctcatgaaaaattgaaggatatattctagatgagtgtttggagaaatctgatggactcttgggaaagtaaattataaaattaaaacatatttttttttcagtaaagtgtaaaactggtcatcctccacctgaaagagaatactaaactttaaaccaaaatataaaaagaaagattgctagttgttttttatctaatcctttttggtgaaaatattagtttgaaaattgttatctaaggtccctgccatcatttggaaagtcaagtgaaaaaagaaagaaaaagtcttctgaacattagtctgaattccaaacctcatcataaactctgggagaaaggtgaaagttcagcttttcctattggcctggactggaatatctgcctttctcttgcagttatatctctattagcaaattgtctggaagcaaatatactttagtcagctgtggtcaaacatgaaaatgctcatgagatatgcaaagcagggtagcctgagctcagccatgatggctgagaacagccttagtctgtctgtctgtttgggtgcctgactgcctgcactcagctacagagcagtggggctgcaagtcctcgtggtttctccttggggcttttatcttttccttttccctcacttagccaggattccccccaccatcacagggctggtcttagcccctccctctgatatcagccattcccactccactttcagcagcctagcatcctgtttgtgatcattctcccagtcccaccattaggcagttgctctaccccttccctctatcaaagcatgaaaggaccatgaggcccagatgcaatggttccaatgtacatttctatttccaccagagagcctttctgtcctggggtgcctggggctaaccacaatgcgtttcctcaaggctctggccccagccttaggcagtgaaaaagaccaaagcctacctgtaccaaggaaattcctgggctgttggcctcttccaccctgctcttacttcctaaccctctcaaccctaacttctcccttctctttacctcagaggcttctgtggcatattttaagtttttccagaatgtccagtgctattttaataagcattgaactccattttcatagtgtatgaaatgctttttccaaaattgagacatgagtctcagtgcctcttatattgttttcatgtctgaaaatgaagtttatgacagaggaatgtgttgatggaatataatatcttcatgaatagaagcattagtaaactggctcagttgtcattaagaaatactttcatttgctttttgacaaaatagtcatgagtgaatagcaagtaatacattaaaaactgctgatttcttattgcactcattcatattaaaataacaatacagaaaataaatatagaaaaacttcacttacaatcctatcgctccatataattactgttttattttcctgtgttccctttcaggcctaggccatgtattaggaggctgctgaatggggctctgaatacagctagctccgtggtaaaggaattcttgtgaaaagttgtgttccatttgtgtattgtacttcaaactagctctgggcactacccacattttaacttgctgtgttaaccagctttagtttattatctcagaactctggctgcaccattatagtagcaacattcatcttttttttggcagtggtggggcctttaccaccagcatatcaaggaatatcacaataagctccacgacactagattttttttttttgagacggagtctcactctatcatctaggctggagtgcagtggcatgatcttggctcactgcaacctctgcctcccaggttcaagcggttctcctgcctcagcctctcgagtagttgggattacaggtgtgtgccacaaatctggctttattttttttatttttttttatttttagcagagatggtgttttgccatgttggccagattggttttgaactcccggcctcaagtgatctgcccgccttggcctcgcaaagtgctgggattacaggcgtgagctaccgtgtccggtcaacactagatcttaattgcatatttccaaaaggttagtgagtttatggatattaataggccttcgtacataagagctgaattccctctttatctgggattcttatgttctgttgatattatggaaagttctcagctcaagacaggcaatgaattgggcctgaagtcatactctatcctctaaacggggcagcaatgcatatttccaagctcaagaaagaaatgactccctctggcctctccccctttctaattttcttcctgaaattgtagacgtcttatcttggtatttatagcatatgcctgattacaaaagtaatctgaagtgttgatgaaaaacacaatttcctggggcctttccaggcctattgaatcagaattctgtggaatggcttggtttaaacaggcaccttgggtgatttttacaatccaggcagatttggaaacagttgtttatttgaaggcaatccatagctaccagctcacacatgtgcttagcacacttttgaggaaaagtagccagtcgttccatcctcgggggatcaatggttgtgtaggcctttgtccttattccatcctaaatacggcatggtcacggctatacaaaatgtaggacggggtggcaggccaatgtgggaagataatcttctctgtcaaggtcattatacataatactgccacagccttcactttgtaattgggaattatattccttatctaaattataatttgtacatgatgggtgtgtgtgtgtgtgtgtgtgtgtgtgtgattttttattatgctttttttcatgtgatcactgggttttaaattcagtttactgaaaaaatgctctctcatcaatcactgtggtattaatttgaaagataagcagattttatgcaactctaggtcatggccaagatctggagtgatattccctgaagtaggctagtcccatagttgtgaaataatggggcttgttttggatgtatgcttccttgctggattccccactcacccagattgatccaggccctcctgctgtctgccagaagcccaccctttttactcacctccctacccttcccagcagggccctattctcccaaatcacccttccttccctcataagttcatctcttgagtcaaaagataaaataagaacaataaaacataacccaactctcctcctctagatttgatgatcttagctggtagaaagaaagggatggatgaaacaaactcatgccgtagcaggaatgactgatggatcttactgcattagcaaatggtcccaaggacatttacatcttaagacatgattgttaaactaaaggaataagtctcaaatacagtgtatcagacagtttaaaaggagagtgaggtgaaatgtggggcagagggatctttaaatcacacaagggccatagttcactgctccccgaggccagctgttgctcttggaaatgtgttgataatggcatttagccaagaaggccagggaaacatttgggtctggttaaagggcaagccccggtctttcgctctacccttcgtctctctcatctccaacagggcactgcatgggtgtgctctctgcacggtgggttgtcatgggagcaaaaggatcatctgccagagcaggggccaccccagcagagggagcatctgtcctggagcagtgcaggaatggtgcaaacccagagtcagggcccttgacttttcattattgaaggctattgacttgtggactaagtggctgtcaggtatagccctttcacgtagacagaatcaagaacctttggcacaggctcttatcactgtgtgtaaaggtaaaaaattgattaggctcaagtggaagaaaacgtgatactttattttttctcagttgaaactttagtctctgtgtctttctgtgtcaagaaaatagtaaaatccaaatctaaccaggcaggcttttcccccgcttgattaaaggattttttttttttttttttttttttgagacagagtctcgctctgtcacccaggctggagtgcagtggcatgatctcggcttactgcaacctctgcctcccaggttcaagcgattctcctgcctcggcctccttgattaaaggattcttaattaagaaaggaaaatctattatagaataaatgctaaatgaaaataaagcaagcacattgaaccctcattcctaagttagaaacaaagctcagatattcatcacagtgtgtttagccatgttatgctgtcggtgtcctcgggtccctaggtatcatgactgcttaatgattttcagtgatgggacaaaactatagagacaaggctggacatagctctcttcaattttatttttcatccctccccccacctactaaatatttcccatattaaataaaaatctgaagtgttagtaacataacttgatgagcctgacttccctcatctgcaaggtttatcagatgatatcaaagaagactttggtctcaagatcaatgattaaatattccaagagaagagatctattttcctgagtgcatttgtatttcatgttgctctttgagtgactttcttgagttaggatatgtgtttaaattacttattcttcaaatgaattggtgaagaagtaagtatagatattttattacaaaatagctaaaagtttatcagtaataactgatacttcctgggtgccaggctctgttgtgtgttttatatgtaccatatctaatcggcacaacaatctcctgagtggttgccatttttgttgctgtttttagttcggaactgaagcatagggagtttggatgacttcagcagggttctacactggctagtggttttactgggttctggatctgggcaaaattattcctcagtctttaagactgaagagtcacagaggctaaagctaaggctaacagccacagagccataatacctctcctgcattaacaacaaagaaacctagaagaatacactgcaagctggtaagacaggtttcctctaggattatgggaagggtgccaggaaaactttggccttatcatatcatttgaatttctttttataattataatgtatccatgtattacttaatataatggataaaactttaacttttacagttaaaattgccgaagtcctaaatcagattaataatttccataaaatcattactacttaaaaaaatttgtcaatgagactcttaaagctggtagggaactaagaaatcattcatcataatcttgtttttcaaatgaggaaactgaagttacatgatttgcttaaactcacagtactagttagtgatagaacaggtctgctactgcccaactttgtgtgcctctgctgcacttttcaacgtgtactttggagcaagacttaacagatcttaagtgaaaagtctgagagtttcagcaaaagcttgtatgcacataaccaactccagagccaagatatagattatttccattactcctgaatgttctcttgtgctaggcatctctttgaaaactttgccttgcccgttcatgtgcgctggtaagaattcaagtgcttatatttcctatatattcacacattttacagttcccaaaagagacacaccttagtgtgtctgtgtacttccttaaagacagaaacagggttttaacaaagttccatgctcttcttatcctttacaaaccagttcctaattactgaaattgctaattgctgttccttgtttacaaacattaactcaagttggtctttagcctgacataattatcattacatataaaattattttttagtcatttaattctgaaagctccccagacacatttataatcagagtacatgtctttttttttttttttaactgagcagtttctatattacaatcctggaagctctaagaataagacatatggccgggcgcggtggctcatgtctgtaatcccagcactttgggaggccgaggcgggtggatcacctgacgtcaggagttcgagaccagcctggccaacatggtgaaaccccatctctactaaaaatacaaaaattggctgggcatggtggtacgtgcctgtaattccagctactgggagggctgaggcaggaggatcacttgaacctgggaggcagaggttgcagtgagctgagatcatgccactgtattccagcctgggcaacagagcaagactccgtctcaggaaaaaaaaaaccacaaataacagaaaaagacatatttactaaaaccagtgcatctgaacatgggcaaatttgattttctgtgctttgttttaactggatgaagctttccagctgagttggcaatggtcttctggcaatcatcagtcagccctgcccctgagcatcttcctcttttcctgtttggtttgctccttggtcttggtgaatggtgtgtgtgtgtgtgtgtgtgtgtgtgtgtgagagagagagagagagagagagacagagagagacagagagctcgctgcagtctggcaatggtaccaatgtgctgatgattaatttttgagaataacttcatattcacaaacatggaaaatgtcctctggcatgagtggatctcaatccatataattttaacatctaaaacagagtacagtcctcgttttagatcttgttctgcaaaattattccaaaatccctaggaaatagtcccaaaagatataaagtaatttttatgaatatattcatagcagtgaattacaattgtgaaaactagaaataatggaaattgttcaataatggaagatgctgaaaatgatagagaactatatagttactaaatgggattgatatgtgaccaagtggatacatggaaatatttaaattaaataagataatattaagtgaaaaagaatattttaaaatttgaagtactatataaatagtaatttacagtcatggaaaaatatttataccttaatagaacttggttactttcctacctgaaagtaattttgatttttttttttttttttttgagacggagtctcgctctgtcgcccaagccagagtgcagtggcgcgatctcggctcactgcaagctccacctcctgagttcacaccattctcctgcctcagcctcctgagtagctgggactacaggtgcctgccaccacgcctggctaattttttgtatttttagtagagatggggtttcaccatgttggccaggatcgtctcgagctcttgacctcgtgatctgcccacctcggcctcccaaagtgctgggattacaggtgtgagccactgtgcccggccagtaatttttattttaatgctttctagggtctttgtttttttaaaaaaggttctatttcataataacttcaaactgcagaaaatgtacaagaatggtgtcaagatgatgtcaagaatttcccctgaccccacgtaccctttactcatattcaccgatttttaactctttgccatagttgttttattatcattttctccttccatatacacatattactttttctgaataatttgagagtaagtggcatacatcatacacatttacagtagttccttttttttttaagacagcgtcttgctctgtcacccaggctggagtgcagtggtgggatctcagctcactgcaacctccgtttcccaggctcaagccatccttccacttcagcctcccaggtagctgggactataggtgcgtgccaccaccacacccactaatttttgtattttttttagagtgggattttgccatattgcccaggctggtcttgaacttctaggctcaagcgatccacctgcctcagcctccaaaagtgctgggattataggcctaagccaccacgcccagccaacagtaattcttcaatgtgtctttcccagaaacaaggatattctctatgtaaccacagtacaattattaaattcaggacatttatatgggtacaatacttaagaaaaatccctacagtccaatattgtcctttctagcatttccctcctccagctcagaatgcagtccaggatgatgccattatgtttagtcatgctatctctttagtttggatgaactcacctttgtttttttgttttttttttcagtcttttatgacactgacatatttgaagaacatgggccagttattttattttattttaattactatttttgtgacagtcttgctttgtcacccaggctggagtgcagtgttgcaaataggactcactgcagcctcaaattcctgagctcaagtgatcctcttgcctcagcctccccagtagctgggactacatgcatgtgccaccatgatttttacattttctgtggagacagggtctctgtgtgtttctcagattgctctcaaacttctgggcttaagtgatccttctgcctcagcttcccaaagtgttcagattacagacatgagccaccacaccaggttagttactttatatttctcagtttgagtttgtgtgatgttttcttttgagtttcagataatacacatctgctagaaaactacaaaagggatgttacatctttttcagggtatcgcatttggagtcacatgctggctgcctgtatttcattggctgtgttaatgttgattatttgattatgccattgtctggtttctccacagtacagttactatttttccccttacaattgataagaaatctgaggagagatgcattaaaagcacataaacaccatgcttctcattccactctctcccctagacctagcatctatcttgactccttttaaaagccacgttgcccaagacttatttacatgtaccctaggtaaacaggaaaacctgggtgattttgctgaggttgtccctgtgcctgtaatacccccattcaagcttattttgtaccacaatttaaggctatctcaaagtgctgtctgtttccctgtccttaactaaattttatgtcttcctcttcaacctctaggagcactttgtacttttcttggggcacatattaacttctactttgtggttgtaagtatttgtgtatttcctttatcctagtcaccagactaggatagcatgatgccttgagggcacggactgtgtcttaatcatttttgcatactctgcagagcccagaagaggctttcagtgggaggcacatgatcagtgttcatgaaatgcatatttatactcctagtacttaccacttctgatgtgctagttgaatacccaattgtgtatttcaagaactcctcaatttcatctgcttaatatctctgcatctcctatttaacaacatgttgctattttgcccttcaagtagaaatggaaatccttcagtgtctgtcatttctgtattcttagctcaggtgttaagaaaagtgttgtcgagtgaagaagttacttccttaccatgaggatttgtatttgtgtttctgtctgagtttcttacaagggcactgggccagattcttattgcttgacaagaaggtatgatgagtctgctcctcctctggggcattcttctaacactaattaaggataactttgtatgtgtattgataggagagtgtatccttacccaaagattcccctgtgtacaggctttagaatctgaaggtataacctgccaaaatcacaggagttaggagccaaggttattaatttgcttagatagtattaatttgttctgccaagacatgtaagaacaagcattaatttagtttgtaagtttaatgaacgattggaagaaccaaaattctaagtaggtcaatcaaatctaatggtacaactaacttgcaatgttggaaaaacatgtccagacagatgacactgggatgcttgttactttatataggaaatgtacaaaacacataaaacctttttctaaaatgtaattttttataagcttttgaaattgatgaagccatgtcattcttcacagtggggctttcctttagaataggaactgatctattattattttttaaatacatttttaaattttagaatagttttagatttctagaaaagcttcaaaggcagttcagagaacttccatataccctcactgcttgcccctattgttgtcattccacattactatgtacatttgtggcaagttagaaaccaacatcggtacattattattaataactaaaattaatgcttcattccaatttcaccagtttttctttagcatccttttttattgttgttgttctaggatcccatgcaggacatcacattatatttagtcatcatgtgcaatgcttagaatgttttccccctccaaaactcatgttgaaatttaattgccattgtgatggtattgggaggtgagacttttaagaggtggttaggtcatgagggctctgcccttatgagtgaaccaatgatgttatcgcaggaatgggcttgccccctctttctctctcttgccctctctttgtccttctgccatgtgaccccttccaccatgttatgatatggcaagaaggccctcaccagatgctagcaccttgacattttacttcccagcctttggaattgtaagccaacaaatttttgttcattataaattacctagcctagggtattctctagcctaggatattctgttatggcagcacaaatggactaagacatcatgtctctgtagcctcttctggtctatgacagtttctcaaacttttcttgtctttgatgactttgtcagttttaagaagtactgatcatattttctgtagaatgttcctcacttcgggcttcttcagtatgtttctcatggttagatggaagtcacggatttttgagaggagggtgcactacatgtctgtggtccaattacacacacacaccacatcacattaaggttacatactatcacgtcatattaaggttacatactatccacatgatacatcatattgatgttagctttgatcacctgggaaagacaatcaggtttctatactataaagttactttttcctcactttccatactctgctttttgggagcaagtcgctatgcccaccagaataccctaaagggggtaagtgggtgggaagtcaagttctgcctcttggaaaggagagtatctacgtaaattattggaattgttctgtaagggagatttgtcctttctcctatttatttattcaaccatttatttacatcagaatggacttttggatctttattatgctttgggatataactcaatattatgttttttattttgttgctcaaattgttccagctttggccattgaagcctctttcagttggcccttgtgtctctttggtgtgccccattgttttattttttgagtacttccttgctttctaacactataatacaacatgctccaggcttatcttatgtattttctgccccagcgctagaatcagctatttctccaaggatcctttgttcattttatagaacaatggtgttagaaaccaagatctggttcaaattttgacaatatgataataaattttggaaatgaaaatgagagatatggagagttagaaagcattggctttgctgactgctactgactttgaaccacaactctgccatgaataggagagccaaccatcccagtttgcctgggactgagaggtttccagggatgtgatattttcagtcataaaacaaggatgaattggccgcccttgtcatgaaattggttatgtctcttggttgcaagggacaaaaaaacaaataaagctccctcagttaaaatggaaattcaatgactgatttaactggaaaatctaaagatataaggggttcaagccaagctggattcacaggtcaaataatgtaattaagtctcccactcactccatatttcagttccattttcctctatgtgataatttcttcttggactgtgcatgtggtgggaaaagggtggattttctttaatggagaacagttgtcctcatcccctagtgcagtgcaggaatcaaaaccgaaatacctagagggtcaaggcttgcagtgtcaatgagtaaagcaggctgcttggaagacaagaggaagtaatgggaacattaaggggaaactctagtcactggtgctatgcaggaatgcaggtccactgttgccagatacgccaattttccattgaagccagaatgtgaaattctgatttttaaattttggcaactgattcaattaaacaacaacaataacaccattcatacagagaaaatatactcatggggcatacagcttgtgggttatcagtttgtaaactctgcctttaaaagtctaaggccatttcctggctgcctcaggtcatacttgggcacatatgtacagaaagtggttcactaagtgtgcttgggatacatttactgtttttgaaaattgacctcatttaagttaataatcactaagtttatcaagtgcttgctatgtgccaggcatggtgcaaagcagttgatacatttctttattttcttacaataaccctgtaaaagagttactgttatcatcatcataacctttctatagatgaagaaactgagaacagagaggtcatgtatcttcctccatttcatgcagctggagtgaccaaggataggatttgtaccccagcagtctgacagtagtacttagattcttcacccctttgcttcagatggctgcagatggagatacatatcttagagaaagtcatggataaggccaggcgcggtggctcacgcctgtaatcccagcactttgggaggtcgaggcgggcggatcacaaggtcaggagatcgagaccatcctggctaacacaaagaaaccctgtctgtactaaaaatacaaaaattagctgggtgtggcagcatgtgcctgtagtcccagctgctggggaggctgaggcaggagaatggcgtgaacccgggaggcggagcttgcagtgagccaagattgcgccactgcactccagcctgggtgacagagcgagactccgtctcagaaaaccaaaaccaaaaccaaaacaaaaaacaaacaaacaaaaaaaaacacaaaacaaaaaagaaagtcgtggataaaaggaaccttacagatcacctagtatgttagcctccttattttacagatagagaaattgaggccaaaagcaaggtgtaactttgacaaggtctcatagcctgttagtgggtaagctggaataagtccaaagcccttttgctgcaccatgaagctctgggacttgctaactacaaagactgaaagtccatggtgggtttgacaaagcattctaaagtattgacaaattatttctgccattgctgtttctggattgatatattcttcatctttcataaaccagactcttcaagggggaaatattttcttgtctttttaaccagcaaagaagattaaacagttatttttctctaaactgatcatttcatccataagctcagccatcactatggtttgagagagaggttgaaggggtgggaagatgcttcacaaccatatttttccttccttacttctcttctcttctcttctcttctctcttctccctccctcccttccttccttccttcctttctttttcttttattttgtctttctctctttcccccctccttctctctctccctccctccctctttccttccttccctccctgcttccctccctccctccttcctttctttcttcttgtctcactctgtcacccaggccgactgcagtggtgtgaacacagctcactgcagcctcaacctccgggactcaagcgatcctcccacctcagcctcctgagtagctgggactacaggcatgtgccactatgcttaaataattttttatttttttgtagagatggggtctcaccatgttgcccaggctgctcttgaactcctggaggcaagtgattctcctacctcagcctcccaaagtgttgggattacagacatgagctaccatgcccagccaaatatctattttctaaagcctttttgccaattcctaagagatatgtcaccgagaagccttgaaagctgcattttgtttacatggacaaatggtcataatgagcagtttcaaaaacaccaaattccaatatgtgatttcttaaagatatatacatgtaaatttaacagatatgtacaggtagttttcttattgttgttttttttgtttgtttgtttgtttgttttttaactcaggctgaagtgcagtggtgcggcctcagctcactgcaacctccacctcccaggttcaagccattctcctgcctaagcctctggagtagctgggattacaggcgtgcgcccccactcccagctaattttgtatttttagtagaaacagggttttaccaggttggccaggctgatcttgaactcctgacctcaagtgatccaccttggcctcccaaagtgctgggattacaggcgtgagccactgcacctggccagcagaaacagatttgagaagagtacggaggggatggggagttctgaaaagtctaattggaacactggctggattataggtctgtgtgtgttctaaagtggttctaaacctaactaccataggcaaacatagctcaagtgtgtcataccatataaatattttggaatacagaatggagctattgtacaacaatgtctggaatgcttagtttggatcaactaatcaaggaacaatgaacctgaaaaggccaggggagatttttttttaatggaacaaatgtcattatacatcaacattgttttaaaagttatggtagctatataaataattctatgccctggagaaataattctcacttttttgggtaatttaacattctttgaaatgctgtagaatttaaaaaattttccattttgcttggataactgccatactagcttcaaaaggtgcagaatagttgtgtgtgtgtgtgtgtgtgtgtgtgtgtgtgtgtggtgtttaagggaaagtagaggaagccttatgggccacccagggggtaaactcacaatgggaattctaaatgagggctccttagctggttgtgtttgaagctctgatcctgactcccttccttagctgccataatccaccgatggagccttacctcgagagacaatgccagtttctcctcattgttatgagagtaaccctgatgtaagaacctcattttccaggcaagatcaggatttagcttctatttaaacaggtctttggactagagctctgatttttgcctccaaacagattcttctagctttgggtttttaagatcagttctgattgagaggttaggaagacagttttcagtgtgccttctaatgctccctttaggcctttcctaattcaaatctgcatttgtctgggagctgtaataattttttggatgtggaagttggggaattgggaaattagttttagttttgctgattatgtttctaaataagattatccttttgataagattgtagaattgaattattccaaagaatatctagacattttaccagccatcaaagggatgaccaaatctgtcctcttctctccttaccactcccctccccactcttcctcttcccttctctcatttatttattatctatttgtctatctatccatctgtatgtctaacctcaatcagtcatctgtgagtcatgtctttgtctactttgttttgttttgatggaatggcagcaaaggatgataagagagcagtagttgtctgaagtctcaaatatcactggagtttgttcaaagtgttgcgtgaaggtagttcagtcatacctagcttgtattatttgttgaaatcgtggtcaaggaagaaaaggacttttctggggttgaaagaggcaaaattcagggtagtgaaacttgaaaaatggagcaaagaaaacttggttaaagataaggctgtaatgccagatgacaaaaacaaaaacaaaacaaaacaaaacaatgaaactccttttctctttccagagagagagactaatggccccagctcctcatgtggtctcattttccagttgccccaaaactttctgctctgagacccactatggctcttctttctgcacctctcacctggtgaagcgacctgtggccccactgatgctcaggctgtgacagtactgcaatgaaaagagagaccagggtctggaggtcccaacagcaagtagtgcttctagagagaactcctccccagccagcactgctcattgaacagcttacaacccatgatgagctgtttttctaggaggccctcttccattccccaggcccaaacgcctctgtgagatatgggactaaacaatgacccacacctcttggctaaacactctggataacactggttactcagcttcctctagccttccaggacagctcacaacataccccacattccaataacctcagtgctagaagtccacacctcctagatcattatcgcttgtctcaacactgctttttaccttccccactctatcttgtttatgctgctctgcaatctcagactcctccactgccctctataattcttggttttccattaccaaacttttctacatcccaaaactgctctctgaacatttgcttccccttcttcctctaactgaaacttggctgttccctgaggaaatttctttcctagaagcagtttcctcccaaatggaagatgtcttgtctttctgtcagaggtgttcgagctagagtgactccatcatgagcaggggctggataaaatgaggctgagacctactggaccacattcccaggaggttaggcatttgtagtcacaagatgagataggaggtcagcaggactggtatcacaagattcaggcaaaacaggacaccataaagaagccagccaaaccccaccaaaaccaagatggcagtgaaagtgatacctggccatcctcactgctcattatacactaactgaatgcattagcatgctaaaagacactcccaccagtgccatgacagtttacaataccatggcaacgtctggaagttaccttatacattctaaaaaggggaggaaccctttttggaaccattctgggaattgtctgcccctttcccagaaaactcatgaataatctaccccttgtttatcatataatcaagaaataatcataaaaatagccaaccagtagcccttggggctgctctgtctatggagcagcgattcttttgtttctttacttcactcatgaacttgccttcagtttactctgtggactcaccctggattccttcttgcacaaggtccaagaaccctctcttggggtctgcatcgggacccctttctggtaaacctttatttggctgtaggtagagtaagtatcttttttcttcctattgatccttccaaactatctatccttcttttgactttgaaaaccctaagtctgttgagttcatgtcttcagactttaccacctaatctctcttctaatagttgtcatctttcagaatctcttgctgtctctcatcattctttgatgactttatcatctagtttattgtatttgatttcctccattattcctacaatcctgttggttttgctgtccttgtagattatccacccagtaccctggtctctcaatttcttgaacttctctacttcaaatatcttcactccactgcaaccagccactgccattcttacagccacaccatagacattattaacagtcaataccaatagcctttaaaatctctggacagcaatcactatcctgctgtctgattatcacattttgagtctctatctcactcctaccagttcccttggaactgttctttgaccctatagggacattcaatccattgatcctgctgattttattttttaatttccctaactttcatattgttatttatcttcttgttaagctagcttccatggtctggcacttgagccagattcttgcagaaaacctgaactttcttgttttcctttctctccactgaacacatctgaaaaaactcaccccttgtgaaacccagttatcctcctatgctgtaactacacctgagaaactaatgttactagaggaaattcatacaaccatgatgactggacttgcctaaagttttccactgtaaatcccaaatggaatccaatgctgctagatgatgctgtttcacttccttggtacattcaccctcctacactctaggacaatctttcttctaaaacctccattctttcatcccattcactctcagccaataacctcggccaaggaaatgtagctaacttagaattgcctcatcttcccatcactaaacctaccaatctacttgcatctgtaccctccatgtattttatgtttctttctgaacactggaagtagtgtttctacttctgatgtccagcccctctgttagcgtcttagatcacatcacatccacatttgtttactcaaggacctcaatactggagttaccctctctcttcttaattattgttttttttcatcatggaattattcctaatgatatacaaacatgttttattattaatcatcccttgaatcccatgatttgagggaacctaaaaaaataaaataaaataaaactatatctcccttgacgtcacatcatcctcatatgttttatttctttccctctcttcacagtcttcaaactatttgtttatactttctgtctctactttctcatttttttcctttcatatgcccattccaagtacacttttttgtacccaccactctgttgaaatagatcctatccagtttatcaatagcatctaatatagtggtcaattttctgtctgaatctaattcagcctctcactagcatctgacacagttgatctctctttccttctttttttcatgcttaatgatgtttattgtttgcttcacaaatgaaacatgttagtcaataattctgaagttatgattattaatagataatgaaagcctattcaaaattcactttactcttcaatgatgtaacttttcatttggaaatttctctgcagtctctcaataatttacacatggagataattgaatatatgacatgttttgaagggtaacttctaattgagtagatacatatctccttttttgaaaccctttcttctctaagccatcacattttcctccagattttatctgattttcctctggcttcccttttcagacctttgcttgttctggaaagggaaaccagtgaggtaggaataaaatctttactgcacttctgtgttggaatgtccctgcattgggagcacagactctggagtcaaattgcttgagtttaaattctgattctattacttcctagctatatgaccttgagaaatttattgtatcatttccctttttgaaaaatgaggaaaaatcatagtacctgtttcttagagatgtggtaaagattaaatgagtttggctgggcacggtggctcacacctgtaatcccagctcttgggaggctgaggcaggcggattgcttgagcccaggagttcaagaccagcctgcaacatggcaagaccccatctctacaattaaaaagtcgggtgtggtggcctgtacctttggtcccagctgctcaggaggctgatgctggaggatcacttgagcccaggagttcgaggctgcagtgagccatgatcatgccattgccatccagcctgggcaacagagtgagactatctcaaaaaaaaagtaaatatagaccatcttagtgtctgtttatagtaaatgctatattaatggctatactaatggtagctattgttatttcccaagcttttaaatttggtgctgaaatggaaggggactcgccttttgggttatggagctggaaaatgccagttaatgactgctggtagtcctttccctaccatgtggaaaaagtctgcatgagacgagattgaggttaacacatgaaaggagtcaagaaaaagggaggagtataatagtcaacattcttgattatgaacaacagatccattccaaatagtccaaaaataagcaaaagtggatttattaaaagatattaggtagctcaaggaatttccagaattgctggaaaacaggcttgatagttcattgccatggacattgaagctaagaacactggctgatcttgctgaaaaattatactggcaaaaacatcattcctactacctgttgccaattgatatggcaccaaccctgaacctgaagccataatctgtgttgctgttgccccaaaagaactagattccttgaccactgtccttgtcaggaaatcaatctcccagtgtggggccatcactgattataactcccctccacattcaagtctcctgtagttgtatctgtttggcaatgcctagatcatacacctttactctaaatgcaaagaaatccagtaaatgtaattttttatattctacttttagaagaaataattcacaatatggaaaactataaaaatgtgaaaatgtttttcagcagctataaataatatgttttcaatatagattcctgtggtagagagggggaactgttgacttcatgtgaaatccttggatccagctggacctaagactactctttggaacttcatgttttatgaaacaataagtttcttcctttagttgagagagtttgagttagctttttgtcagttctatttagtgttattattaatgcagcttccaacctttctgatccaaggttcactactgcaatatccccataattggtctcttgccccccatacccacccttctatcttttctcttctctagagtcaggtaatttttcataaatataactatttatgtcatccttctgcccaaaactctaaatggctttctgttgctttttgatgaaaaccaaggttccaacatagtatatactctctataactgggctttgttcactttttcaggcttaacctttttgctgatttttctgctcaagtcttgctggccttaattttgttccttaaacatagcaacttctcatcttatcaaggccttcagacaggctgtttcttgcccctagagagctccttccactctgtcattctcccttatcctcctactgctcaatccccagcaatctcctctttatcttttgtcttttgacttagatgttacttcaagaatgtcattagaatgggagctctttggagccagggaatttgtctgttttgttcactgttgtatgcccactgcgtagagcagtgaatgttgaatgaacaaatgagggaggaagggtttcatcctcccagtccgtgagatttcttcttactttcccagcatgcccaaagcctgtaattttttgtttaaatcggcattcacatcaaagcacactgctatagttaggatgtttgtcccccaaaccttgaaatttgatctccagtgttggaggtgggggcccaatgagagctgtttgggtcatgggggcagattcatcatgaatggcttggttccatcctcacagtaattagtgaattctcgctctgttagttcccaccagagctggttgttaaaaagagcctggtacctccctcccctctctctcttgcatcttctctcaccacgtgatatctgcatgcactggctcccctttgacttccaccgtgcactggctcccctttgacttccaccgtgaatggaagcaacctgaggcttttatcagatgcccaatctttcagccagcagaaccatgaaccaaataaacatttttttctttataaattattcagtctcaggttttcctttatagcaatgcaaatggactaagacagaaactatcaacagaatgaaaaagcaaccatggaatggtagaaaatgtttgcaaatcttatatctgataagggataatatccagagtatataaagaactcctaaaactcaacaataacaacaaaaaatccaatttaaaaatggggaaaggacttaaatagacatttctccaaagaatgtatacaggtatctaataaatgtgagaagatgcccaacaccactaattatttgtaaatgaacatcaaaatcacaatgagataccacttcatactggctattattaaaaacaaacaaacaaaaaaccagaaaataacaagtgttgatgaggatatagagaaattagggcactaggacattactggcaggcatgtataatagtgcaccctctgtgaaaaatggcatagtggtttctcaaaaaattaaaaataggcttaccatatgatccagcaattccacttctgggtatattcaaaatattgaaagcagggactcaaacagataatggtacaacaatgttcacagcagcattattcacaatagccaaaagatggaaagaacccaagtgcccatcaatggatgaatggataaacaaaatgtgatatttacatataacagaattattcaaccttaaaaagtaatgacattctgatgcttgctacaacctgggtgaaccttgaagacattatcctaggtgaaataagccagaaacgaaaggacaaatattgtataattccacttgtgtgagatatctagtgaagtcaaattcataaagacaacagataaaatggtcaaaagaggtggggggcagagggaaaaggaggattattatttattgggtacagaatttcagcttgacaagatgaaaaggggtctggagatggatgttggtgatggttgcacaacaatgtgaatgtgtttaatgccactgaactgcacacctaaaaatgttctaaaatggtacatttttgttatgtatattttacaataaaaaatgtaaaattaataaaagaaaaaatgtaaaatctatattttctgctaaatgtaagtttaattggggcaggaaccttgtctttttcactgctgtatccccggcatctagcatagtgtttggggcatagtagaatcatttgttggaattgaatgaatgcccgaagttggggagaaaccaggtttccattcagggaatattggacaaaagccaacgtagcgttttgtggcatatctcctgctgtgcttctcagaagtcactaagccaaatcataacttctcaggatcttagtttccatgtctaagatttggtggatagtctttgaccaaccttttggtgggattcttgagagaactgaatgatgcactctggaggggatcttgtagtacatggaattactcagctgccttttgcatgtgtcccagtcctgggctcttccctgaggtgcccagtcacccctgtccttgctgccagtcaccatccaccccttctccaccccatacgtctcagctgctgccattctttctcctacgctggaggcactggggctgcattgtgctttaaaacgatggaccataaagcctttgttaagttgcccgtacatcctttatgtctctacatatatcagattgtaagcccccagaggagcagagccaagttgttaactcacattcacggttctaaattcagtgcagtgagcagatcgggtttatcctcatgatgatgaagaggaattggaagacttttcttccattatatcgaatgcagctactgaattttatagggtcctcttagaattttctggatggtttcctttttttcacttgaataccttattcccctggagtgaaatgcatagagatagagaggtaaatggtctgaaaacaaatgtactgtaatacattcactttggctgcaaaaataaaacaacccaaacctagtttttcttgcagtctttaaatccagatggtagtaaaatttgacatttcaattctgtttgtgaaattcattttgtttttaaattgggaagaactatagagctaaaaattgtctgaagcactgggaaagcctggtgagacctctttaggagtgttattaataaggacttggtattttaaagtggatttggaggcactgtagatagacactatcaacaactacaatggatttgaacaaggaccctgataccaagaagccacatccctactccatacctaaaatgacagagacagaggattggcctggagaatgcaaggaaaaaagaaatctggacaaaaatagagactgttttggtagccaaatttagttaatatttttttaaagaaccaattccctagtgggcttgcagctgaaaatttagcattagaattccacttttagttggcacataactatttacattaactgtatagtaaaatatttatagttctcattccataaggtaggttatcattctcaacaagtctgtctttataaagttctgaaattaacaatcatgtaaggcctttttacaaataaatttctgtactataaggattcagcttaattgaacttaagatttaggggcccagagtggtcaaaatcaggtaagatgccccccttacagaatagtttattggctaggcttatttctgatggtgtctgctctctctatattcctggagaaaagcatagaaacaaaccagtgtctatgttgtaagcagtgtaccagttaagtttcttttggttgaaagtgaaggaagctcaaccaaatggaattaatcaaaaagggaatttataggcatttgtaactggtccgcttgaagagcctggtttacctgttgcttgacgcaggtgcccagagacatttccagcaccaggtctcacctcattttctctctcttccacatgttggcctcattcttagataaagtctcccctcatggttgtaagaaagctgcagccttccgagacttcacactcccaagacttcaagtctattgaggaagagaggacatctcaccctcagcagataaattcataaagacagaaaataaaatggtggttgacagaggccccgcgtttggttctcagtagcctgaattaggacatgtgcccatccctgaatcaattattttgtgtaagtggattgaatctgccgattaacttagttcagtcatggctcatactggatttaagagtgggataagccatccaaaccacatggcccaagattggtggaaaagtggaaaagtggttccatgaaggagaattatgatagttatagggaccaaaacaacagatatcagctataaagttgcatttaataaaagtactcaagatttttatagaatatttacaaatattgactttattatttgctaggatatacaaaaaatgcataaaaagtctctttttggtttcttatggcatgagaaaccatctaattcttagagttgatacattataagagttttatgcttcctgattctcatgtgtttaattatgaaggtctgagtacctgactgctttgatatattgtagaaaaatatgttaatgagctattttctccacacctttttcctgggaaatgtacattctttggatttggagagaatgaatttcttcagagtctccttccttttgctaaccacattctatatttagaccaaaaggagaaagagttatttctggcactgggctgaagaaaatccttctgtgtgtgagtattgctaccatatacataaactgtgtatttgtgtgtgcagtgacagttacatcttccttcactggctctggtacaggttcttattctctgattctttctctatttccttacatgtctcttcttcctctccataatgcataatacatatatgtatgtgcatgtatatgtacatgtatgtatgcatgtatatgtatacacaggtgatattaaaaagtatttaacaaataaaattacatgaaagtctaccagtcaaagtggatgtcagccataaacaaccaatatcactgtacagggacacaggagctgaatataagcctatatgggccttatatcatgggaacaaaaaaattattaacaggtgaatttccaaagattcctgcttcaactctcccagtgaagatggggaggggagtggagaacagagagagcacaagaattggatgaattgtccttgggaaaaaaggagtaaaacagaaaaacgtccattacttgttaggacactacacatcagtggttgtgatacgatgggagaaaatctgtttaaaggtgagaggaattagaggtgaggaagaagaagcaagaggaggaagagatagtgagaaaattgcatggatgagagagtttcttggggttggaaaaagagagtctccaaagagtttcagatagaatgaagtggcaagatgagaaattttaatgtgtttctctggattatgtgtttgatttttctttcaatatccttcgagaagtgcaagaatattgctctaatatttccctggaactagatgagttgggtctacaggtttgtaaaggattatacaccaaaaagagatgtgttagagcttttggtaattctgtttctttgcccatcgtttctgctgaaggggtgggacatggtggccatgttttgtgcctgcctactcccaccttgttatgacttactgaactagggaagggttcctggctcaggcattggccttaaattggccagcgactatggtgtgatctggtaaaaaaaacaaaaacaacaaaacaacaacaacaacaacaacaaaacaaaaacaaaaaaaacacgctggtccactcagctttctcctttggggaatttgtaccatgaataccagtgcattcattcagttgttcaactatggttagttacaagtacctaatgtccatcgacgctctccagggtactgctaatgactaggaaagaagggcaattttaaatacacaaataaggcaatttcaggtgatgaaaactgctctgaaatagttaaagtggagatttcacagaatgttgttgggacagtgagctactttagctaggctgggcagagagggcttctcaggtggtggttgagctgagacttgaataagataaagagccagaagatttctgtgccaggcagaagggacagcaacattagaggctctgaagtgggaacaagtttggcatgcttgcctggagagtgagtgaatggcagtgggggaggtgggtggtggcatgactgtgaagaggaagccaacgcctgatgttccagagtcatgagggccctggtcaggagtttggattttattctaaatgcactgagaagccatggagggtttggagcagggcaacagcatggtctgtgaataacgaagacatttactgagaaaggaacacatctaggggagaaatcaagaaggaaagagtttacaatgggagctaccactgagagctctgatgggaaatatatgtgtacaccaagacagtgaagaagcagaaaccatgctttagatgaagaagcagagattccaagctagagaggataggctgagggagccagccaagaggaagagaacagcagaactaggttgtgagtgagagtgaggtggaaagagtgctcaatactttagctgtttctgtggtggcttcctagttgccctgagaactgtatgtatcacagttcctctaagatccccttttctgttattgctctattgattctttcagtaaaacaccccttcccctttaaaagctaccttgagggactttgttactagaaactaaagctagctaactaaaacgaatgggatcatactatacatagccttttgtaacttgtgttattcccttatcatgatggaacagatgtctttcatgtcagtagatgatagaactgcaccatcacttttgtggcacatagttttatgttggacacttcttactctcacacttcacatcttctcagttttactctggccattgcataggtgttaccttacacgtacctgctttagctgcaccatgtatttgtcagtttctgccctggggcttctcacaccccacatgggaaacttgtggggacccatttagcacttgagtctgtgtagacttggaagtgtgagggtgttaatcctcatgggaaaacccttgatcgatgggagatgggagcccgtggctaaatgcttcccaattctgtctcttaggttgacaattaaaaggggcacattctacatggtttcttagagcccctcatttgaatcaagctccagtttcccatactttctagtttgatagtgtaccttaatagtggattttctttctttcctgttccatttctcccagtttcccactacttttccttgggttgacaccctaaaataaactacctccatgcaagttcctgccgtctgctttctggctgaaacctaggctaacatagtattgcattgcctgaatgcatccaaatgtagtgtttttttattgatggacatttagattatttccttttctcattgttataaccaatgttgtgatacattcttatgcgcacatttttgtatatttctttgcatctttatttcattacaaaaaattactataaatgaaattgcagtctattactgataaacagcaggaatgtacatcttctttgtttgtttgtttgtttgtttgtttgtaaagaccagatcttgctctgtcacccaggcttgagtgcagtggcaccattatagctcactgcagccttgacctcctgggctcaagtgatcctcccgcctcagcctcctgagtagccgggactacgggtacgcaccaccacgcccagctaatttttaaatttttttctagaagagtggtttccccatgttgcccaggctggtcttgaactcctgggctcaagcgattgtcccacctcagcctcccaaagtgctgggattataggcatgagccattgcacacagccccacgcatatacatcttaacggcttttggtacttgctagaaccaaaacatttgtatttaacagtttcacatgtttgtgggaaaaattagccactaatgggaggacattgtctataaaaattatcctaaatgactgattacatgttgagggctggctgcattccataactataagctaataactcagttgtgactaaggtagagagacttacttcacttggttcaaatcaaacgtaacactgagttctttgggcttgactttgagtctttttaacactgtgaagtaagaagtggtgagagatcaaaaattaatctgagagagtcactttatatattttaagatgattgcactggtgatatcactgctcaagaaagtttgcaagcacacaaagacctttaatctctaatgcttaagcttactataataacatttttcttaagagagaaaaaggggcaccaacaatttagaattccttatatcattaacactaaaaaaagttgccctaggacttcttttctcaaagaagctgtcaaaattgacccaaggtaatcctcctaaactctatgtccttggggtgaaggtgtatctcacctttacttttactgtagtgaaaataaagtggaagttaccaagtaagcagagaaaactgtgtaataacgtttgataccatatcatattaaatctgttctaatctgttcttataattgtattgctttgattacttaaattttagaaagccttgtatttcacagtgcataggtaggtggcttatagttgataatatttggtgactggtttccaaaaagggttgctcagttgacacttgcttagaagtatagctatttcaacagtaaataagattctacttacatcattttggcttacagcacttttcccactatctttttttttttttttttttaatttgaggtaggatcttgctctgtcccccagactggagtgtagtggcatgatcttggctcactgcaacctccacctcctgggttcaagtgattctccctgtcagcctcctgagtagctgagattatgggcatgcaccaacatacgcagctgatttttgtatttttattagagacaaggtttcatgatgttgcccaggctggtgttgaactcttaggctcaagcgatccacctacctctgcctcccaaagatttttcccattatcttgacatgtaataaaaatgttgggcattagcctcttggtcaagagtgaacctctttataatagcattgtttctatggaaaaattaaagtctatgttttgttgatttgaaataactttgacaggaacttaactcacataaatgaaaaattgcttgtcttataggtcttttttctctttgtgtaaacttatgggatatgtgatcacaaacattaatgcagtttaaagttgcttttaagtagtatgccttttaattaagtttgtacagaagaggtggatccagaacttggaggctgggacatgccagtctggggagtttgaggtgggctgtgtggagctattgaagcttttgagaatttaagtaaccagaatgaatcagaatttttgaaactataattgggtcattgaaagaagacggagatctgttagaaaactggtttagggatgagataatgaaggcctgagctaatgtgctggcttagaaagcaaacataaagggggaaagggataaaggcaatatctgaaaggacctaggatgctgaataaaagtggggcatgaggggaaatggtaagaaggactgcaattttgtgtttgagggagtgagggtagggatttggcttttcttttctttttctttttcttttttttttttttttttgagatggagttttcactcttgtcgcccaggctggagtgcagtggtgcaatgtcggctcactgcaacccctgcctcctgcgttcaagcagttctcttgtttcagcctcctgagtagctgggattacaggtgcctgccaccacacccagctaatttttgtattttttagtagagatggggtttccccacgttggccaggatggtctcgaactcctgacctcaggtgatccacctgcctcggcctcccaaaatgctgggattacaggtgtgagccaccacacctggcctggcttttctaccactgtatctacaggtctacagcagtgcttggcatgtaggaggtactcaataaatagttgctgaaacaatgaagggcatttgtataatcaaacatgagataaagttacccatatgacattctcaaattgattcctcccttaatatttgtgtaacacccatctggcactcagtgtgaatatttaccaaccatatagtatggctttttctctcaccagcaggcctaatttggcagactggttttgtagcatggtagcccttcatcttcctcttggagtgaattttagcttccctaaagggtgatgtttgcataactcttccttcatctttggaacaagaacatcatttgctagtagaccttgctactcatttccttcctccgtaaagtcgttaagagcaatgtgttgcattagtatttgcttgctttgtgtggtgtatgggaactggaaggaaagggttcacttgcagagaggaagcctaaggagccagggcttatgcccagaaatccttcatcaaataaggatttatggaatacaaggacagtctagaagggtagaatccctgtccttgggaaagttaagtagaggaggccaaaatggtatagtggaaagagtctaaacaggaaataaagaaaactcatgtgacattgaacaacttaacattttcttgggttttatttccttcatatgttaaaaaagagagacttgggttagataatctcaaagactctttcaagccctaaagtctataattctttttctgaccttaaatgcattgatgaactatcatttgttcctcaccatctcttctgtctagcttccttctcaatacttcgcctgtgttgcatgtttctcccagcaatttctttaagccctaaccaacattctgattgtgtttgtagctataatcatggcagcaagtcttcctcatttattcagacttaataacttagtctatttaagttaggcaaaacatttgttgtgtttgaaacagctagtttggtaagattgtaaaaggtgccagaaatttattaggagctgcctcagatacatcagcctgtttgctgttagtgtctgtgacccacatatttacaccccactctgtttcctctgagtcacaacattccacttaggacttggtggttgtggttggccttatcaactctaggccatcacttggaatcatttttcttgcctaatgccacatggacacatagtcctatcataagcattaaagagtaagcagatgtcttgttaggtggcatctcttcttgctgttaaggaaggcctgagctcgctcttatattctttgttcaacagatttgttaccggaccattgcctattctgtttttaaaaagctattacagcatttttcctctctgagaaaactccttgataaatacatataggaatgttgacatcagattcttatgtgtttattaaatttgagaagtggagcttaacaaggagggcatggttttaagctgacaatgtagtgctataaaatacaggggaaggctcggaatggtggctcatgcctgtaatctcagcactttgggaggccaaggtgggtgcatggcttgagcccaggaacttgagaccagcctgggcaacataggaagatactgtctctataaaaaacgaaaaataaaatacaggtgaagaccaaactagaatgcaggccctgagtagaacttctaaactttgtttataaatgcaatagtattgagtccctaaaaaaagacactgtctttgagaagaacacataaatgtttagagataccatatacccaaagggaagtattactctgtttttcgttgttgttgtttcagatgcttggcttactgtctggaattagtagctatcgcatctgggtatttatagagttctagtgggagctgttaatgaacccttcattcaaatctaagactaaccaagactttcaatttcagagcttttttcctaggagaactgatttagaaacttagaaaatacatttcttcacaaacatggtataaactttcataatatatggacaaaaacaagtctcattaaggccgaatgccttaaagggtgcttacttgggtaactatagtcagatagaacccacccagtccaagtgcctgcgattggggcagatttaactactatctagtctcattcaagttcacatgttgctcagggcttccgtttcttgacctagtgctcccctgggtgtcatggacttatgagtttcttggaaagtcctcaagaggcagtttatatgggatttaataagcttttgaggatgagtagatgtccatctgttagatgctgcaagggtgatgtgtaggcttttgtcaatggtggactctcactctacagctcctcagcttggctgatacgtggttttcattagaatagtgctgggtggttgatgagtattggctcagattccttacagttctctggtattagttatcatgtagttcttccatgtctattcctcttctttaccagcacagtcacccaccactaccatttttcttttaatcacagcccaagtgatcctcagttaacctgggagatggagaggggatcatttgcctctctctattctgtttccaatctattattatgacataaactccatgccctgcttccttcatttttgctgtagctgttcaaattctctgtaaggcaatatgggtgcctcagattgagtaggatagggtcactccaaggaagtgcagaacatttttttaaaaaccacaaaggtgggttgggcgcggtggctcacgcctgttatcccagcactttgggaggctgaggcaggcagatcatgaggtcaggagttcgagaccatcctggccaatatggtaaaaccctgtctctactaaaaatagaaaaattagctgggcgtggtggtggtgggcacctgtagtctcagctactcaggaggctgaggcaggagaattgcttgaacccaggaggtggagattgcagtgagctgagatcacactactgcactccagcctgagcaacagagcgagactccatctcaaaaaacaaaaacaaaaacaaaacaacaaaaaaaccccacaaaggttagtatttcaagatactacttcactgtgtatctcaatacaataattcctggaagggattccttaacttggagttttatgaagatgtcaaaagtagttgttgaaaccgttgaacctagattgtcaaaagaagccctcctggtgattaaagcctatgaattaaaaaaaaagaggccctcttttgtagaggccttttaggggttctgacatccctaagaagttgatgagaaactataatttgtgtggcatagagaagagattacataaggattctgttcctctttttacatgtggtccagagaatcctcttctagacactgagtcctttattcctaattcctgtctgatatggtttggatttgtgtccccacccaaatctcatccagaattggaggaagggcctggtgggaggtgattgggtcatgggggtgaatttcccccttgctgttcttgtgatagtgagtgagttctcatgagatctgatggtttaaaaatgtgtggcacttcccccttcatcctctctctctttcctgccaccatgtgaagaaggtccttgcttcttctttgccttctgccacgatcataagtttcctgaggcctaccagtcatgcttcctgttaagcctgtggaattgtgagtcaattaaacctctttttttttttcataatttacccagtctaaggtagttctttgtagcagtgtgaaaatgggctaatacacggcctttacttgtgcattggcttaagtctggcattaagccctgagcctttatcagctggcttctctgggatgttttacctctctgtactgctctaccagaactggcaatggatatgcaacaacacgattgtctttctaatgggctcagtgtcagtgtctgtgtcctccttagcagattagttctttttgaggggtcagacccttttgttccactgtggtcaagagagagaagttttacagctttttcggtggctgtctcgcctttttttttactatgcatattctgcttatgtatggatcacctttcttgaagtcccccttgtggtcagtaacataagacactggagtccagtggcatggtctcagctcactgcaacctccacctcccaggttcaagtgatgttatgcctcagcctcttgagtagctgggattacaggcccatgccaccacgcctggctaatttttgcatatttagtagagatggagtttcaccatgttgaccagggtggtctcgaactcctgtcctcaagtgatccatctgcctcagcctcccaaagtgctgggattacaggcatgagccactgtgcctggccaacataccacatcctgagcaataactttatacatctcctgggtatcagtggcttggcacattggcttttcatcacttcatttttattctcccatgaattacgtttattctgaagagcttggcctcagttgagactgagaagttagtcaccttgactacttcttggtattgtcattgtaaatgttatttcccaatgtgaaagatgagaacctagctttctcttacttatctcccctgcgcctatcacatatttgctcacttcccattcctccatcctcctaatatggatatgtggtggttttagtagcatcaatattcagtgattacatgattatgattatataaatattcagtgattacatgatatgattatgtatataaacccatttatctgagccacgataatattttcttctctgtacaactttttattttccctgaaactaataattttcatgtttatacattttttgtcttctttgtgcttatctgcatatatcaggggtcagcaaactgtctcgtgggacaaatccagcctgttacctgtttttgcaaataaatttggtttgcttattgtttatgtctgcttttgccctacaacagcagagttaagtagtgtgatggagactgtatggtctgaaaaacctaaaatatttattatctggccttttataagaaaaatttgcaacctctagcttattataattcaacctcaaactacaaatttttagtctctctgcaacgtattcagaaacattcagtattctactgacttcatttcctggggcaagctcttctggagccttctgacttgtttctgacctttcaattggtctggttgccctatgggcctgggacacagttgtcaggctgtgtcaccctttatcatccatctggagattctctttgctgtcttctgtggtggatcctttgttaactgtatctcatgtcttatttcttttctagtgctactctttcatttcagtagaatatattctcttgcttcctgaaaaaggatgaatggaaagtcaattttttgagactttgtctgaagatgctttttaaaaaatctttccttcatatttgactaatagtttggattggtttaaaattctaggttggggaaaattttcttctgcttttttttttttttttttttttttgagagggtcatactctgttgcccaggctggagttcagtgacaatcatcagtcatagctcactgcaaccttgaactgttgggctgaagtgatcctcccgcctcagtctcccaagtagctgggactacaaacatgtgtccatcacgcccagctaatcttttatttttagtagagtcaaggtctctctctattgcacaggctggtcttgaatttctggcctcgagcgatccttctgctttgacctcccaaagtgctgggattacaggcatgagccactacacccagtttctgcttttgaagccattgttcccttatcttctagcttccagtattgttgttgggatgtctaaaaccattttgattccatttgttttctatatgactttaaaggaagtctcttcagtgtttattggattgtctctttttcccaatcctctgccatttcgtaatgctatgccttgctgtggatctattttcattacttaggcaggcatttagtgagtctttttaacctgaaaattcatgtccttcagttctgaggattgttcttaaattatgtaattgatgttttcctcctgggacatactttaaggcagagcttttttttttttttttaagagaaaatatattaacatttattaagtggaagtggatcatcataaacttcttcaggatgagtaggctgaggagggggaagaggagggattaatcctgctgtctcagagtggcagaggcagaagaaaatctgcatataaatggacccacacagtttaaagctgtgttgttcaagcatcaactgtacatgtatgttacacctgagttgggcaatacctacaagtccttgggctacactcttgcctttgaccataggaaccacgagaaaatctcaggcatttcttcaggctctgcctctcacccttgggtttggatcctttttttctttttggtaaacttttttattattatactttaagttctagggtacatgtgcacaatgtgcaggtttgttacataggtatacatgtgccatgttggtgtgctgcacccattaactcatcatttacattagatatatctcctaatgctatccctcccccttcccccaccccacaacatgccccggtgtgtgatgttccccttcctgtgtccaagtgttctcattgttcacttcccacctgtgagtgagaacatgcagtgtttggttttttgtccttgtgatagtttgctgagaatgatggtttccagcttcatccatgcccctacaaaggacatgaactcatcgttttttatggctgcatagtattccatggtgtatatgtgccacattttcttaatccagtctatcattgatggacatttgggttggttccaagtctttgctattgtgaataagtgccgcaataaacatacgtgtgcatgtgtctttatagcagcatgatttataatcccttgggtatatacccagtaatgggatggctggatcaaatagtatttctagttctagatcctggaggaatcaccacactgtcttccacaatggttgaactagtttacagtcccaccaacagtataaaagtgttcctatttctccacatcctctccagcacctgttgtttcctgactttttaatgattgccattctaactggtgtgagatggtatctcattgtggttttgatttgcatttctctgattggcagtgatgatgagcattttttcatgtgtctgttggctgcataaatgtcttcttttgagaagtgtctgttcatatacttcgcccactttttgatggggttgtttgtttttttcttgtaaatttgtttgagttcattgtagattctggatattagccctttgtcagatgagtagattgcaaaaattttctcccattctgtaggttgcctgttcactctgagggtagtttcttttgctgtgcagaagctctttagtttaatgagatcccatttgtcaattttggcttttgttgccattgcttttggtgttttagacatgaagtccttgcccatgcctatgtcctgaatggtattgcctaggttttcttctagggtttttatggttttaggtctaatatttaagtctttaatccatcttgaattaatttttgtataaggtgtaaggaagggatccagtttcagctttctacatatggctagccagttttcccagcaccagcaccatttattaattagggaatcctttccccatttcttgtttttgtcaggtttgtcaaagctcagtgagtcctctgcaaccatgacacttagttgctggctgactttgggcaagtattaaatagggataatgatgatgggaatgacgatgatgatgatggtgaaaaagtagcttgggtttttgtgaggttaaatttaaaagtgcctatcaaaatgcctggcaacatagtaagtcccagactttctctcccaaacccctacatgtgataagaaaaaacagattagtattaggattgtttctacactttaagggaacatgtaaactatagcctgtgctgtatcagaaggacagtgaataccatgtagtgctctggttttgagtagttcatacttcacattctcactgcccttgagagcttggtttatactatgtcaactcacacgtgtttagctcttatgtcacattataattgctctcagatagttttgatggacattttgcctacccagtcagatgataaactacacaaaggcagggataccttccattaactttgaatcatccatagttcctggaacagggttctgtagatgaaacatttctattcttagtgataacagcttgaaatgaaacatttacttattcttcttattggttgaagggatagaacgtgaataaaacagagcttaggggttttggagaatgtgattaccaactcaaatatccaacaagatgtttcttagcagttgtctggatgacaacatgatgatcctgatttattattgctttgctttaaataccacttaggagataatagcaatttactgttggctctggtttcctattcatcccttcactggtcttgggtaatgttattgtcatacacaaaaattgcaatatgtaaaacatgcatagtttctattttattcataagatccattagggcaagaaccttgccttagtagctttcatatttccagtgcctagactagtgcctgacacattataagcactcagaataaattatgttggatgactcttcatacttatacgtaatgctaagtaaggctataggcgagtactttggggtgctgagagtgtgctggttttcaaaatagaacattagtttttctcagacttctgagagtttgtggtcttctaggtattctaggtatttgaccacaaataatctatgatcattttatgttatgaaattcaccaaatatcttctattttttttttttttttttttggagacagagtctcactgcgatgcccaggctggagtgtagtggcgtgatcttggctcactgcaacctccacctcctgagttcaagcaattctcatgcctcagcctcctaagtagctgggattacaggcacccgccaccacacccagctaatttttgtatttttagtagagacagggtttcaccatgttggctaggcttgtcttgaacttctgacatcaagagatctgcctgccttggcctcctaaagtgctgggattacaggcatgaaccactgcacccagccccctatttttaagtttctctgaaattttactgaaagagttaacttatttagttatagaacaattaagttagatctaatatttgataattcaagcagtgtacacatgcatatattgataagtatgttttactcaaaaatattttcactgtggaatatcctagaattgcatcacattaaaaaaattatttaactgacaaatgattttttattgtagtaaaattcagttagtataaaatttaccatttaaatcatttttttccctactgcctgtaaaattgcagagtcatctttttttgttgttgttgtccttttaaaaaaaaaaaaaccagggtcttactctgttgcccaggcctgagtgcagtggcacaaacagagctcactgcagccttgacctcctggtttcaagcctctgcttctcaagtagccgggactacaggtgtgtggcaccatgcccggctgttttttattttttattttctttgtagagattaggtctctctatgttggtcaggttggtcttggactcctggactcaagtgatcctcctgcctcaatctttcaaagcgctcaggctacaggtgtaagccactgtgcccagcttagattaagcatttttaaagcatacaattcattggtatttaggacgttcacatggttgtgcaactaccaccactatctagctccagaacattttcatcaccccagatggaaacaggagacaataagcagccactccccatcctcccctacccacagctcctggaaactactaatctgttttctgtccctatagatttgcctattcttggatatttcatataaatggtatcataccatttacagtcacaaagccttttgtgactggcttttttaacttaacatgatgttttcaaggttcatggatgctgaggcatgtctcaggacttctttctattttaaggctgaaaaatattctattggatggttataccatgtttatttgttcattcatgaattgatggacatttgtgtttttttctgtcttttggctagtagaaatagtgctgctgtgaacactggtgtacaagcatctgcttgactccctgttttcaattattttgggcatatacctaggaatgaaattgctgagtcatatggtattttatgtttgacttattgaggaatcaccaaaaggctgcacactttacattcccaccagcaatgtatgagagttctgatttctccatatactcatcagcatttactgttttctgtttttttttaattatagccaatctacaaatgattttaaactttgttacaaattcttatccctctgtgggagcatatttataaccccacattgcatatttctgggacagttttgatgtttgatctgcttgttctccgggcagagggagtgtgatttctgtaatgctaactgtgctctccagccgcccggcattgtgttgtttgggtgtctgggagtgtcagacttggaatgttactgttgattgctgtggacagttttcatctctgaagggaagatatacaggtttggggctagagtgaagactgttcttggagatatttttaaccacgtccaaataactccatgccaacaaatataaaatgagtaatcattctttttgttttgatgtcaaaaagaatacatttgtaataactccactctttttctaaaaaggagtagtgtcttcttctgtcagaaaatgattttagattacagtatttggcaagttttagagcttcactgtctattttatgatagtataaacgttttcttctttgaaagacaaatttacacaataagatatgtaagaagtagagtaaagcagcaatgtttaaatacattgttatgttcaggttttagatcctgacctgaattttagaataaatatacaaaaaaggtgtttttttaagttcatctaggggtgattgaggctacaaaatttatgccatgttttcaactgtcaaggctgcttttagaatccagaggaggcctgtaagtacaaagatgtagagatgaataaagaaagacagtggcccattctttctgttttttcacagtctcccttagggtgtgagttaggtgcttatgtgcaattaaaaaaaaattattgattggccgggtgcggtggctcacgcctgtaatcccaacactttgggaggctgaggtgggcggatcacctgaggtcaggagttcgagaccagcctgaccagtatgatgaaatcccatctctactaaaaatacaaaaattagctgggcatggtggcatgcgcctgtaatcccagctactcgggaggctgagacaggagaatcgcttgaacccgggaggcggaggttgcagtgagctgagatggtgccattgcactccagcctggacaacaagagcgaaactctgtctcaaaaaaaaaaattattgattgattagggatgtgggttaaatggtaggctggtaggctgctattaactttctcatgtacttccccaaagaagcccatgaggtagaaacacaaatgtatggatatcattttaacactatactatactatttgggaaacattttagttttattgggagggaaacatttattagtatctcaaaagatgccagtcttcaaagtactctcctacctgtgacaggaaccattacataagaaaattaacgaaagacctgtagagaataaaaggtaaagaaatactgtatctaatagtttctagcatataaacactggattttaggtagcattattgtacaatgatgtgcatagtaggctttcaaaaagcgtttgtagaattaatgaaggaaatgaataattcattaatgaataatgaagaaagaaaaaaattgtataaactgaactgaactgaaatatttaacttaaaggaccaaataatctaaagaggaatctttatttgtttctgctcccaaagagctcatgttttgtatttagttatagttcaacaatgtttatttaatgccttctacatgcgaggcactgagatgacgtaaggaggttagataggggatgagcggaatgtaaacaaagatgtgtagtaatagaagtacttcaaaggtcagaacagacaggatgatgaaagaggaggaagacattaactctgccaatggtggcatattagaagaaattaacaaaagaattgagctcagttttgaaggtaaatgctggtttatcaggatgacaatgggcatggaaattctgggtagcaggaacaacattgatagtgacaggaggcagtcagatgcctaggcagataggggtgagtccccagcaaaatcccacctccaagtcgaagaccatgtaaagcctgaaagccaagttacaagttaaatgctgggaccagattgagaacctgtcttcccatttggtgtgctttcctctgattggtctctgcctttcacccattttacatatacctaccctttcctaattggttttctacattgtggtgcccacctttgagtggtgtctttgctttaaacttttttgcatactcacaaaccaatcagcatgcactccccattctgagtccataaaaagccccagacccaatcacacagggagaaaccacccgactgtgggggcgggggtaccttcctcccaccctgcatcccctctcttctgagagctgttctgtcactcaataaaatcctctgctgtcatcacccttcagtcatcagtgtgatgtcatttttcttggttgctggacaagagcttaggacccactgagcacaggtactctgaaaagctgtagtactggcccttgcccttgccagcagagagcagccaccctgcacaatggagcaatggaccgactgagctgctaacatgctgccataaggctgcggacagtggaactacaagagctaattatcacactaacacctgctctggggcttcagggtcaagggcatccctccctgggcactgccctattcccttcgaggtaacatgcctggcttggccatgggccctgcacagagcttgctcctgtgttggtggtcagagtggctggccaggttccacacttgctcgctcacatgctccctcctgcaaggggctgagcatggcaggccaagtagagggggcacccctgctgcgaatccagcaaaggggctgaaaaaaatccttctttgacatggctaagatgtcgaggcatgaaccaatgtagtgtgctcaggaaatacaaataatttggcactggtggttctgaaactgtaaggtttaaggagaaatagggaaatatgaggctggaaagatactccaggcctgtgtcatggtgccttatattctataataagggtcttgggatttatctggtagtcactggaaagccattcaattgctttaaacaaaggactgaccactgagatttggaattcttgttgagatttttttgtggagcagtatttctcccaagagcacatacattaaaatcttctgttgtgcctgttaaaaattcagagccctgaactccatcctggtataaagcaaaaataaaattttaatccccttgaccatcccaatggccccttctcttggcaagggcattccaaagttaaatggaaaaactagttttagaccatgatgggaagggggtgttggaactccttccttttggaattactgatagaacagactttttaagtctgataagaaacatttacaatctattctcaaagtctgctaccaggaggcttcacctgcatgataaaaccttggtctccacaactccttatcttaacccagacagtcctaagtttttagacaataacctaactgtttcaatccatgccaatcaataagtctttaaatctgcctatgacttggaggcccttccttccaagtagttgtcctgcctttctggaccaaacgaatgtacatcctatgtgtatctgatagatgtctcatgtctccctaaaatctgtaaaactaagctgtaccccaaccactttgggcacatgttctcaggatctcctgagggttgtgtcacaggccgttggtcactcatatttggctcagaataaatctcttcaaatattttacagagtttgactctttttgtcaacactgggtttactgaatcagaatcctggtggaaaactttggaatctgtgtatttaaccttccaagaagatccccttgcaccctgcagttttgaacacattgctctcaggggtacggggttgaaaaggtgggcaagactgaatgcagagaggtcatctaggaggtgatgtcactccaagtgagaaagtttgaagtagtgtcaatggggatagaagatagaatatgataagcttgagagatattttggggataaaatcacatgtagttggtgcttggatagactgagtgaagaagaaggtttcaagccaggtttctgtcttaattgtcgggtggtgcattaatagttattattaaagttttaataagttatacttttccttttatatataatttaaaaaatttgatacattcctaaatttgattattgtttcctttcagggccaacttgttttgttgttgaattttatggtagaaataaaatgaaaaaatgtcacttcattaaaatctgttatactcaacttgtcaggaaaacatttatttattcagttgtagatcccaaagtacctatttgtcaaagtacctaaaatgaataaatagctttatttctgatatctctggaagaaattatacttgcaaaacttaaagtctaattcagcatccagccaaagttattggaagtatcagccaatgagctggagacacagcaaggcttagtagatagatctttcaagtcaggcagaacccaataaaattattaaatatgtatatatgtctctgtcactgtcccttttccatctcttcctttctggtcctgtcctgaagaagagactcctacatactacttgtatctattgttgctactaattcttgttaactgatgtgctgacaaataagaaccaaacatagaattattttgggaaggtggtggatattataaagcccacccatttctgcacttccctacatttctcagactcctgtgcagttaggttggccatgtgactgatttctggctaatggaatgtgggtggaaatggtgttctctacttgtaagcttcttgatcttccatgctctgaatctgaaatatcctgcatatctaccatgctctccttatctcattcctggtcctctaaaatggctccagacatctgcatcagactttgcatgagcaagaaatacttttatcatgttagtctgctgagattccagcttattctgtaacatagcattgctgactctgatcaatgcataggggtattctcaattttatgggtgactactaacggtatttaagttaaaaatggatgaaactaggctgggtgtggtggctcatgcctgtaatcccagcactttgggaggccgaggtgggtggatcacaaggtcaggagttcaagaccagcctggccaatatggcgaaaccccgtctgtactaaaaaatacaaaaattagccaggcgtagtggtgagcacctgtagtccaagctacttgggaggctgaggcaggagaatcgcttgatctcgggaggcggaggttgcagtgagccaagatcgtgccattgcactccagcctgggcaacagagtgagactctgtctcaaaaaaaaaaaaaaaaaagggtgaaactaatgatggaatgatacgcattgaggtgactctttagggataaaggagaactcttctggtacagacttaagttacatcataaagataccctccttgagccctaaggctgtttcttgacatcagaacttatcttttatgtgcctggtcctgctcccatcatgttttcagtttttttcttttttttcttacttacagagtggggtgattaatacccatgtgatggaattattgtggagattaaaagaggtgccatatgtaaaatgtctagaccagcgcctagcacatagcaggcgccagagccatcctgggagagcatcagaaatgcgatcccataattaactttgtaaacttctgatgtgattcacagatgggtgttatttacattagtgacatctagtagttttaaagttcttacttaaaatttgaactctctaaatttcagtgtcatagggctctgactactctgcccaagttgctgcactgataagtgtccaataaatgttaggtatctattgttgttttcctattgttcttcaaaaggaggtgaaagtaacattgccattgtggggattgtttgttctacaggcttgggctgggaaggccggatctccatggccaggctgttagctgggcagtggtgtgcaactgattggactggtgccagtctgactgactcgttttaaaggtcagaacaactagactgaaccatgggcataataactatatgttctaatcatgcttatcctcaaattgtttctttctgtaaacaaaagcaggaagagcatcacatgggggtggaatggtgcatttcgaaagacctgagatcagacctccatagttcccagctttgctgctgtgtgacagtgcagacttatttaacctctgtggcttcatttcctcacctttgaaatgagagcattagactagaggatcttaagggtcctttctctaacctaccagaacctaaacatagttgaagttccacatgactcagcctctgtgaaagaatgaattcaaaggaatggtctggtatctaaatggtaattaggattcttcaaatatttttgcagtctctcagtaaactgccaaagtggagtgtgcattttttttttttggaacggagtattcttttttaaaaaacagctttattgaggcgtcatttacataccatacaattcatccatttaaagtatacaattcgatgttagtgtggggtatgcattcttactatagaaaaagcatcttaaaatctactttactgttatcttcattttcttccatatggatatcaggtgatccccaaagctcttaatctccaactattatctcacaaaccccaaactccctggcacctattccacatgattttctggtctctctccctccttcctcttgctgcctctctcagctctttaatatatacacaaacggggatttctccactcttctgttttccctctatttgctcattatttagattctgagcaacaaatgagagtccaagagcaacctgagcaggtgagacattttccctattagacatgaaaaagaggcatggatgtgaagtcccacacctaaatattcttttaaatttctattgccctatgggcacaccgtgacttactcttccacttgttcttcctctgggcagttccagtcagctttgccattgtgcataacaggaagtggagtgctcttgcaaggaaggcctagagtttcaggagacaaaccattgagttaatttctaacagattaacacagattccacttgtctcgttcatgctataaaactgcaagcctacagttgcctttgttttcacttctacctaagatgagcagggctctgatgctatctctgggatggcatgggtgtgtctgtgcaagggcaggccttccttgtctgccagagcaggcccctgcctgataaggccacgccaggcctctcagctccctagggagtcatcccatgcattgtgaaaattttaccatgacccagtttgttccgtgtgttgttttattgaatttcatactgatgaacgtcaattattattaagtacctgctgtgttccaaatatgccctaagcattttgtgtaatacaagggggtcctcagcatcatgtagttttaaaatggagatgtataatgataattgacattatcatattagaactaaatagaagcttatcttttagggcaaatttgaattcttttttaaaaaaattgcaagtgtctttgtaattgattaataaacaatacattgtttattgtaaatttttttgtaatacagagatgcatgaagaagaaagtataaaggatgagaaattctgcttcctagaaataactactgttagagttttgatgaacattctttgagacatcttgctatacatacacacacatatatattatacatacataattttacataaatggatttataatatgcttactatttgtaacctgcttttttttttccactcagcagtatgtcaggaactggtttccctatcaataaatgtagacccacctaattatatccaaatgtagcagaatgttcaattgtatcaccataagttattcaactaatcccttattaatggaatttaaataatttctaattccttaaaatattataagcaatcattgcacctgtctgcagttatactcttagcacgcattccctggacgtggatttgctgggtcaaaggatatgagcattgaaacttttgagacgtaatgccacacttggctcaaacaccaacccccttgattcagatgctgttgatgacccactcatatcttcttggtccactccggaggtctctcagatggaacaagtttatagcctgttgagtgtctccaccaggaatatttgctagctgtggagcccgttcacaggcagggaagcatgaagtgctggaagtgcactgggagttaatgtgacccctaactacaaaatgatgggaactggtggataaatgctccagtttcctttccccgaggtgggactattctaatgtgtgttgtacacagtccctaggagaatttagtctagttgcctgtagtagtatcctgctcatttaactcacaagttatttgctttcctcccttactacctgactgccccactcctttactgggcttcgtgggacttctactcaaatcctagtctcagggtctgcttttgcaggagcccaaatgaagacatccttcatattacaggtgaaagttgtggtaggtacaataatggccccttaaagatatccatatcttagatcgctggaacttgtgaaaacattaccttacttggaaaaagggactttcgaaatgtaatcacatatgtaatcacatcttaagaaccttgagataggaaagttatcctgtattatctgggtggccctggtatgatcacaagggtccttaaaagtggagaagagaggcagaagaagagagtcagaaggagatgtgaagaatcagagatgcagcatttctggctttgaagatggaggagggccatgagccaaggagtgtgggtggcctctataagctggaaaaggcacgaaaacagatttacccctggagcctccagcaaggaacctagttctgctgacaccttgaatttagcccagtgacttctgtattggacttctaacctacagtactgtaagataataaatttgtgccacatttgtggtaatctgttatggcagcaataaaaaacgaacacaaaaagttaaacaatacaaggcaactggtgccagaagcatcatatggcagtgcctattgttccaaaagaggagcgtgaacagtgaggctgagagaaggatgaaatcatgaaacttgttccttcctcttgagcacagagtggtttgcctgtgggtgtttagagtagtggcttaatgaccactaaatataggcctgtggccagaaaccctcccaatgagctgagggtttgtatgaattttaatttacttgaaaattccatcagatttctgaaaattttagtgtgtataaaaattatctgggaaaataaaaagttaaaaaaaagatcatctgaggaatttgttcaaaatgtagattcttggatcccatttgcctgaggttctaattcaaaggtctggaataaggtccaggaatttgcatttaaaaccaggttactctgacacacattgctttaggggactttcctactagaaccctctgctctttggcagttgtgggggaggtctacacggcacccactttgtcaggcatttgcgtaggtaaggtgagaagagaaaggaatcactagaaattgtctattattgtatcacatccaaatatcctagttttgtttctgtttgggggtgtcagtcacaacagtcattagcatcaaccagaagcccgagtgtaatagatggggtggcctgtgtcaccagaggcagagcatctgggccctgggcccctgaggattgtctgatcttatgattggtttgcttacaatagcattttctcatttggctgatgggcaaattgttttcagatgaccttggagagccagggtagtttggctgttactaactggaagctgcacattcaaacatttggaatatcctgaggattacagatgtgctgaagggtgtcttggatctcctccaatgagggtttcagaggtcatctgaaaagaatgctcgcctctgcctcatgccttttagaaggaggctctgtgcttgtctagctttatgcagctctctgaaatgtcagaagataagaaatgcctctcagcacgaaggcttccagacacatatgtgacaagaaatttggcatcagctttataagtgtcagatgtctaggataaagcaatatgggtatagtatttctggtgctattttggtgccttgtgcatgagcctgcagcattagaaaaactgcttttcagctttggatggtagccttactggcgctcggcatgcatgtctgaaagtacagttgggtcatattctagttatggtccacagcaagtcacctagagttgtgatattgagctttaacggagtgcccttgaggcacacgggcatttcacagcctttgacaacttgagtggcacagccacagagactgtcatcagatggtgccatataagccttaatcaactcttgcaacacccgtgcaaagttggtaaacactcttatccttgcttttcaggcagggaactaaagcaaggagaggtccaacagacagggtcacagactcaatcagttcacttatctgactgttgaatgatctcaggtgaatgagatcagaacgaatttctactttctctaactcaggaaatttgtcttctggcgagagagcatttttggcactttgtgacttgctgaaagacttgaagtttccagtctggctctggctgttcattggttaagagcaaatgcctggggcacttggcttaatgactgtcataagcagtgtgaaaaaatgtgtaagaaaaaacaaaatatggtaatgtagagaggttgttaaggcagtaatatccaatagcaataatgtgtataaagtctgagtgataatacaacccttttacccaaggtatttgatactggctgaggcctcttttatttatttaaaatccagtgatgagctctaaacaccgtagtttaagaaggtaaaaaaatacttgcagtgcagagttttctgaatgattcaaaaatggaagtagaagacccatgagaaaagatgaaagcattgctcttaatttgtggaaagaaagttgatgaaaaattacaaggtctataaatgtatcacaaggtttttagagaagacaaattaattttccactgatgacaaaacttgaaaaagtgggtttatcttagagattgaaagagtcataggaaagaatcttctggtgttgagaatggttaaaaaccagatgaggctacctagaaaggaattcccctcttctgaaggtccttagtaaataggctaaaccagcccagcatgatcaaggttaatgatgtcagctggtgtctccagcgccctaaggtgggctgccagtagtgatcatggtaggattacttttctttcaactttttagtttgaagtaactttagacttacggaaaagttgcaaactagtatgcagagttcccatatatccttcacccagcttctcttgatgttaatattttacacaaccatgatcaaatgatccagtgatcaaaaccagtaaattaacattgctgcaaaatggtggtaggggctttgaggggagggagaataggtaggactgtggactttcacagtccttccctggagcagaccacttttatttgtttatgttggaattccacatactattttatttaaacaaatagttctattgcaaaaatttgaaaaccaagtttaggaagagagatagtttaactgacctctaccactaagattttgtgcttttgataattatatcgtttgtcagataattagagggtaaatgtgttcggtaaagacatttatggacgcaacgtaatgctacatttttgttcgtttcttgatctattcaggcttgttctgttgtaagcaggttatttatacttgctttctctccagcaccaaaaaccatgactggcatatagtctatgcttaattaatatttgttcaatgggccgggtgcagtggctcaaacctgtaaccacagcactttgggaggccgaggcaggtagatcacctgaggtcaggagttggagaccagcctggctaacatagtgaaaccccgtttctactaaaaatataaaaaattagccggatgtggtggcactaaagcgcctataattccagctactcgggaggctgaggcaggagaatcacttgaacctgggaggtggaggttgtggtgagccgagatcacgccattgcactccagcttcggcaacaagagcgaaactctgcctcaaaaaaaaaaaaattgttaaatggaatcaaattggcatgttcacccttttctcatttcttcacatgccttgctccttattcaaatatctgcgtaggccttccctgaccatccaaactaaaataaccttttttctattatctctcacattctctctcttttacctggcactattttgttgttgttattcagagcactcgtcattatctgaaagatgatttatttgttcatatgtttgttaaaagtgtatggtctgtctcctactaacagtaagctccttgaggacattgacattgtcttgttgaatctgtcttgtgggttctagggaatggtatctcatatctgaaagtttatatgaaatatgtgttgaaagaatgagtgaatgaagacatggtcgcctatactttgaagatagaggtaagttaacttcagaaatcttcacttaaacatctttcaattcacaatttgcatatttggaaataaaagatgtgattattttttcagttagagcattgcatttataaatttctttttgcctttcactgatgtaagaaaattatttcttattttaatctcaaatagtgatcctgcggctggtaaccctgtaggaatatttttgaaagaaaaaggataaattctgtgaaactctgagctctaagaaagatgataactgcatttgagatagttgtattgtcatgattaattagtgttatacaaaagtgagagactcacacagccctgtcagtgtcatgggaatcacagtgcctcctaccatgttaataggaaccagatccagttaagcaaattaaaataatttaaaatattatgcatgtgggcatcccacagtatgacaactggcccatttctcagggccaacctcatctatacacagagaaagactcaaaattgtcatgttatctgtgtatgtgtatgtgattaaggtgttacaagaatatctgctgttacatttttttgtgtgcatataggcagcagagtggcacaatgcaagagtgctgggccccaacaatattttatgcacaaaggcaaattaaaaaaaaacaaaaaacctcatcatgactcagttgtgcaagatttcagagagggtgatttagggcagctcagtctggagctctatgttttcctggtggcatttaaggcttaagagctggatagaggtttccaagtagttactgagtgtggtgggcagaataatggccccccagagatgtcgtatccaaatccttagaacctgtgaatatgttaggttacgtggcaaaggggatttaaggttcagataaagtcaatgttgctaatcagctgaccttgagattgggaagttatcctggattgtctgggtgtgcccagtgtaatcacaatggtctttaaaagtgaaagagggaggcagaagaaagtgtgatagtatagggatgtaaagaagactcaaccagcccttgctggttttgaagctggaagagggtcgtgagccaaggaataagggcagcctctaaaaagctggaaaagatcagaaaatggttctcacctacagtctccagaaaggaacaccgtctggccaacaccttgatcttagcccagtgagactcatttctaccttctgacttccagaagtttaaggtaatcaacttttgttgttttaagccactgagttaatggcaatttgttacaacagccatagcaagctagtataccgagtctcattcttacccttatgagaccttccacaatttcatcccatccaacccacccagcaatgtcttctgcttgggtcagatcagtttcctccctccttccagatacattatgctcattcccacctcctagttgttctcccttctgtgggtttctctgttgggaaagaatttctccctcctgctagtataaatctgtgtggacatggtttctccgtcccataaactgctagaccaaccttgatcacccaaactcttcaggtgatcagatgttaaaatatttcaatcaaaatggactaaatttctaacgtgggctataactgatgtcaagaagatgaggaggatttaaaggcttactttaatagacatacacattgactagttgaggaaatatagacaaaagcagtttcaaaatagtatgctgtatgctagaactgaaatgtgtttagggtactggaggaaggaagagaaaggatgcctgattgcctaaattggggcagttgtgagggtcacagattagactcaggtaaaacctttcagagaagaggattcctgggttgccttatgaatggtgaggagtttgtgaggcaacacaaggatgggaaaggctacttcaggcagagaaaacagctagttcaaaggagagaggtgtaaggtgtgttttatgcaggaactacaagttgtttggcataacaatagtgggttaagaagaaagggacaagaaattaggttagaaagagatagaaggcagatagcaaatggttttctaggtcaggctaagtggtttgtagatagaaggatttaagcgataacatgatttgcattttgggaaaattcctctgattgcaacagggacaatggatatgaaagggttgaggctacaggcagagagagaacttctgcgaggctgtggtctagagggggaatcaataaggcctgaactacggcattgataggagatcaggagtggggaattggcacgagaaatagaagggagaatcaacagtaaagaggccatggagtgagtggtggtacccactctttgggataggaaaattgacttcatgaggaaataggtatttagttaaatgttgaatttaaagtactcacagagtgtaaagatggataccgcccagcacccagttggtatcaacttcaggaaaagcatttaggatctagataattttggaatcattcgtatataggttgagtgtgcaagaagagaagaagggagaaccatgtaaatatgtgggatgagaaaaaatggttcaggaagcttgaggagacccaggagataatggtgtcccagtgtcttagtttggcctgctataacaaaaatagcatagacaggtgacttccactacagaatttatttctcacagtttgggagcctgggaaatctaagatcaaagtgctggcagatatagtgtctggtgaggaccctcttcctggcttgcagatggcagtcttctcgttgtatccttaagtggcagaaagagagagaaagctgctcttttgtgtctttttatgaaggcactaattccattgaggagggctttgccctcatgaactaatcacctccaaaagtcctcacctcctaataccatcacctgggggggttaggatttcaacatatgaattttggggggacataaactttctgtccataatacgcaggaacagagggaggagagtgtgacaaggagaatgcgacagcatggaaagctactgagagatcaggtgtaacgacagacatttttgttgtatttgtgtgaccttgttgcaagagtttcattgaagtatgtgagtgagcatcagaggttgagagtgaataagaggtgaggaagtgggaaaacccatggtgaccgcacttccaagaagctgggctgtgggaagtcaaaggtggagagcaatgtccaagttaagagagagttcaacagtctctgggaagtgctgagcgggaacagcctttgagaagacgctattaaatatacaggagagagataggtagagagagaggaaggaggaattgttattgggaaaagaagactaataatctagtataggtagagagtctagcttcaatgagtggaggattccttttaactgagatgtgatgcaggttagtttataggttgtggagtggaaactggatataacaagctggttgacaggattcacaatcagtagccaccatataggaattgtgggtcattttttaaggggccagggtttggggaggaggcttggcagcgaagacaagctttaggatttgcccatggaactgaattgggaactggagtctaaaaagtcaaggaattttctgttttgggtgttggatgggtatttcacatggatgtttattttgcccaaactgacgtcagtattagagtggagaggaacttggtgagtcaggcgatgaagctctcagtaagtgcactcaggtggtgattttggtcacctctgtaaaaactcagctttactccctgtaaggaattgacggaagccaaccctgacagtgtaacaaagctcatctgctggtaacagtgctttatccgacaacagcgaggcgattatgggaaggaatggaggaatgttgtatgtgatttcaaaattggcttataagatatgaactctgaatttcttgtgcctttccaggaagaaaaaaaatatcaatatagataatttctacctgttggctgctgcaccaaaaactcgcttaacctcaatgataattcctatttgttggagccaagagagtagcatttttgaaagactgaattattgaagataagattgagatcattgttccaaggggatcaaaagagataaaagtctttcacttcatgaactctgtgttctcttcttatggctgctgtaattatgttggctggaaataacaaaagtttattctcttacagttttgggccagaagtccaaaatcaaggtgtcagcagggtcctgctccttctgaaggctctaggggggagtcctgccttatgtctgccagctttcggtgggactaggtgtcctttgacttgtggctgatagctctaaactctgcctgcctcttcacagggacttccctgtgcttgtgtcttctccttttctgtataaggacactggtgattggatttaggacccacctggataatccagggtgagctcacctcaagatccttaacttaattatggctgcaaagaccctacttacaagtaagtcactcacaggttctggttgggcacatcttttgggtgggaccaacattcaactcactacaaagcccaaaagatttaaaaatttgtatcagtgaacctgataacctctccaaagatatatatatatatttacttcagagtgccttgtcctttcccataaagcagtgtagggtacccattgctcagtaactaggttttgggttggtatagaattatgtagagtccatgctgagaaaacaggtgttgttttagatgacagtaattcagcaatgtctaacttcattgataacagacttaatctactgatttgggtcgaccccttgcatttagggagccaaagggaaaaatcttacagggtgaaaatatctacatctaaggcctctgcttcatgtatagcctaaacatatgctctaaatctgagaaaagttttaagatctttgctttgccttggaaactatagctggcaagatctagcaaaacttacagaatagaaattccagcaggacctacagaacagatctggagccctggcaatgcttttcagggggcactaatatagtttggtcaatgcagcggtccccaaatcattctgtatgcaggcagatcaaagattgacatgtgcaaatgaagtgattctgacaacattaacatgctgattgcagctaagtgcactgcttgttcaacagttcttcagtagactaaaaaatatttaattgaagtaatgagaaaccaaaaacatttcttattcatgatattatacaaatatgttccgcacgccttcagctaatagttctgtatttgtgattctcaaatatctctgtctctagtcattaattctcatttgtacttctgtctcaaattgaaaactgcttacaggacatttctaatcagaagttctgccatcaagtcagtatttacattttcaaaactaagttaatattatctaagaaccccggcaatctttccccaaatcttagtttctgttattgatgacatctgttattgatattatagtcgctgagacttcccaatttgagagcaagttatagcagaaaaaaagtctggaataagtgttaggatttgagagtttagtttaaattttgctgctcatattttcataattttggttaattcacataacctttgggatctgttttctgatgtgcaaagtgaagagcctgagctggcagctggatgacttatacatgtatttagcaaacttgttttctgtgtcagtaggtcgtttacagagccaggtgtgggaattcagtgtttactgggcctggttccgatcctaacatggtggacctgttctctgctaaagctctcctgcatcaatctttcactgaactccactgattctgctttggcccttccttctctctcccgctgctggcccttcagtcaagaatggggggcactgcagagccaccatctggctccagctccacactgagttgtgctgcacagggtactctcatcaggtcgcttttctcttcaaggatctgatgcttgcagctgggtgcagtgacttatacctataatcccagcactaagctcaggagttcaagactggcctgggcaacatgtctccaccaaaaatacaaaatattacccaggcctagtggtgcacacctgtggtcccagctactcgggaggtagaggtgcaagaatcacttgagccctggaggtggaggctgcagtgagccaagattgcaccactgcactccagcctgggtgagagtgagaccccccacaacaaccatctcaattaaaaaaaaaaaaaatctggtgcttcctattgccccttgtaagtgatgtcccagtttagactgttgtcaagggtcctctgtaaactgtccttgtcttcatgtcttattttatctctattttgctctatgaaacccctccttagttgggtaactctccttattcttcccctcaagtctacctgtctgcacttactgagtctccctcctgaggtactttccccccacctcacctcctgactaaccccaatcaatgaaagccacagattcctgaggaaggtttccccagaacccacaggccaccatcctcacccctgggcctatcgcatattttgcatattttggacatttgattacagagtattatagcatccttacatgttaaacatcttgtaactttgatatgtttcagaactcttaggtctttcgtagcctagcccaggcccagaaacctgagagtagaggttaagactgaaccccctaagtcaggcttcctgagtccttaacatggcttcatcttttcctagctgtgtgactgtggcaatttacttatcctctctgaacttccttttccttacttgcacaattgagacaacaatattgcctgccccagttactcactagttcacatgaatagttattagttatttagttaatacgagtaaagtgtttaagacagattttggtatgtagtgagtgattaagaagtgttagttactgctgtttcattggattagtgtaagaattaaacaagataattcattaaaaaaccctcagtgtagtacctggcctgtagtaagaattcaatattttatttaacagttgatgaggcttgggggaaagaaaatgaccatagtcattgtattagtccattttcatgctgctgataaagacataccccagactgggaagaaaaacaggcttaattggatttacagttccatgtggctggggaggcctcagaatcatggcgggaggcaaaacgcacttcttacttggctgcggcaagagaaaaggaggaagaagcaaaagcagaaagccctgataaacccatcagatctcgtgagacttattcactatcatgagaatagcacaggaaagacaggccccatgattcaattacctcccaatgggtccctcccacaacacatgggaatgctgggagatataattcacgttgagatttgggtagggacacagctgaaccatatcattccaccccgacccctccaaatctcatgtcctcacatttcaaaaccaatcatgccttcccaatagtccctcaaagtcttaactcatttcagcattaacccaaaagtccacagtccaaagtgtcatctgagacaaggcaagtcccttccacttatgagcctgtaaaatcaaaagcaagctagttacttcctagatacaaagggggtacaggcattgggtaaatacagctgttccaaatgggagaaattggccagaacaaaggggttacagggcccatgcatgtctgaaatccagcagggcactcaaattttaaagctccacaagaatcttctttgactccagatctcacatccaggtcatgctgatgcaagaggtgggttcccatggtcttgggcacctctactcctgtggctttgcaaggtacagcccccctcctggctgctttcacaggctgatgttgagtgtctgtggcttttccaggtgcatggtgcaagctgtcggtggatctaccattctggggtctggaggacggtgaccctcttctcatagctacactagacagtgccccagaaaggactctgtgtggggctccgaccccacatttcccttccacagtgcctagcagaggttctccatgagggcctgcccttgcagcaaactttttctgggcatccaggcatttccttacatcttctgaaatcatggtggaggttcccaaacctcaattcttgacttctgtggacccgcaggctcaacaccacatggaagctgccaaggcttagggcttccaccctctgaagccacatcccgaactgtacattggcccctttcagccgtggttggagcatctgggacacagggtaccacgtccctaggccacatatagcatggggaccctgggcccaacccacaaaaaccactttttcctcctggacctccaggcctgtgatgggagaggctgctgtgaaggtctctgacatggcctggagacattttccccgtggtcttggggattaacattaggcttcttgctacttacgcaaatttctgcagccagcttgaatttctcatcaaaaatgtatttttcttttctactgcatcgccaggctgcacattttctgaacttttatgctctgttttaaaatggaatgcttttaacagcacccaagtcaccttttgaatgctttgctgcttagaaatttcttctgccagataccctaaatcatctctctcaagttcaaagttccacaaatctctagggcaggggcaaaatgccgccagtctctttgctaaaacataacaagagtcacctttgctccatttcccaacaagatactcatctccatctgagaccacctcagcctggaccttattgttcatatcactatcagcatttttgtcaaagccattcagcaagtctctaggaggttccaaactttcccacatttttctatcttcttctgagccctccaaattgttccaacctctgcctgttacccagttccaaagtcacttccacattttcgggtatcttttcagcaatgtcccactctactggtaccaatttactgtattagtccattttcatgctgctgataaagacctagcccagactgggaagaaaaagaggtttaattggatttaacagttccacatggctggggaggcctcagaatcatgacaggaggcaaaaggcacttcttacattgcagtggcaagagaacaggaggaataagcaaaagcggaaacccctgataaacccatcagaactcatgagacttattcactatcacgaaaatagcatgggaaagatcggcccccatgattcaattacctcccaatgggtccctcccacaacacatgagaattctgggagatacaattcaagttgagatttgggtggggacacaaccaaacaatatcagtcataattattgtcaaataattaaaatctgtgagttagcattataatgatctctattttttttttaaggtgaggaaactgaggttaagagaggttaagtaacttgatgggtcacatacttagaaactgagtggagcagattaaacacccaggaagcctgactgcagaatctgtaccttttaaaccattattcctatgctttggtcccagactaggcagtgtgggggaaattttgatctgctggtgaaaacaaacatggaatttgggctcacataatccaggttcccatcctgtctttaccacccacctgggcaggatatttaatccttcagcggttacatttccttatctgtgagatggggacagtaatacctcccttgtatgactgtgatgggaattaaagaggcaacattaagtaaagctcccagcacaaggcctggactttagtaggtatttaatacattttagacttctttctctcctctttcaaaatttgagctgaaaacaatatcttttagtgcctttaattagtctgtgatatggattaaatgcaatgtatggcctgcaatacatatgacacagcctgcaagaccaggcattccattgccctgacttggtgttataaataaccaaacatggctggtattaaggacatgtgaacacctggcacaacttattcacaaccactgtcagtgcagtgtttctaattagtggagttcttcctaaaagttgtggcacgtctcggtagggaaagtcttttgccaagcaggtgggagtgagtaaagaatttgagattgcgaatagtctgagttgggaatgctcagaaggagcagagaatgctgggcctttgcacaggcatttcagtgagccttttgaaggtcagagcctgctgatgagaatgctgctggaattttccaaggattgttttattttagtctttggactgagtgttggcgatgacacaatctgtggttgaaaatagcgtgaataattaggttagaagcaacttaatgtcccaagatgttaataaagccagctacttggaattcatctgtaggaattcccttcccaaacttgattcctgagtaggcacaagttacatgatatgcttccacagccagtaagagcaaacattggcctcttgcatatgttgtaaccttcaagtaggcagaacagaggttacacttttcttccttttaaaaatttaatcaagacgtgttaccttacacagagtggatgatctcttgtgacttcactgctcgctctgaaggacaactgctggccagtgcattgagcaagtatgatcggcaccttgggtttccatgtgctttcctgttctgttttccttctgaactctcatttcaaagatgtttcatagtagaagtctatcctgttttatggggttagtttaggaatgcaattatttcctacttaatacttttcatcaatacattagaaatacttcatattcatgatataataaaagcagttgacccttaagaataaaaccctcaaaatagctacatgagaaaaatatgggtgattttctcagctagattagattaaacaagtagggctcagaagctggacttagatcaaattctggctctgccacttattagctgtgtcatcttgggcaaccacttatcttgtctaagcctcatagggttgtcatgagaattatatgagacaatgtatgtaaagccataacgcagtgcctggcatggagtacctttcaataaatgtctgctacttatattattataaacgtgaatattacaaagatttgcaaggttggactctccaagaggagaataagacagcattagaaaagcccctcaacttgacactggccaagcatattattttggggaaacttgataaactgtaaagaacttggttgaatggaggagcctggaactcctttcatgccccttgagtggctagaaggaccacaaaaggaaggaataggagaagttaattgatgctattgccatctctgtaatctttaagcctgattggaattcagtgaaaagatagtactgtaaaatgagaaaaattcagattagatttgctcaagggctctccttctctaaagtctgaggattctattaaatccattcatccagacatttgttgatcacctgctgcatttcaggaaactgagcattttgctgaggttacaaaaatgaataaaaccaagttttggctcttaaagcatttacagactagctggagaaccagatatataaacaatggtcttaaaaatagtaatagaggaacataaaaaataccaaggaactcagaaaaaagtatggcttttattaggctgttcctgatttctttctttctttccttctttccttctttctttctttctttctttctttctttctttctttctttcttttcttttcttttctttctttttctttctttctttctttcttgagatggagtcttgctcttgttgcccaggctggagtgcaatggcacgatctcagctcactgcaacttccatctcccaggttcgagcgattctcctgcctcagcctcccgagttgctgggattacaggtgcctgccaccacgcccggctaatttttgtatttttagtagagatggggtttcgccattttggtcaagctggtcttgaactcctgacctcgtgatccgcccatctcgggctccccaagtggtgggattacaggcttgagccactgcacccggctggctgttcctgttttctaagcagtttgcaaatgcagatccattactgtagtaataagaatttttgactaaaaagaagagatttgtccacatcaagtgaacacatctgttgtaatgaaacattctgactctggaaatgagaatgagtaaaaaaccttgtactttgttcgtaagagaatacagaaattgagagaagaaattctagaggagactcagatcatcttttcaatgtgcccgtctatcttcattaggggaagaacttcagcaaggtcttgctgggatttagccccctgaagtatcgaagatgacacttgctgacagtggaggaaaccgaggaggcagcacagaggatggtgtttgtgcacagagatgagaggggtgcagctttcaccgacaaggggaggagggcacattcccaaccccagggagtgttccatgccagagacggaaagggacagctcagacattgtcccagacccgtccctgtctcctccaaataaggaggcctccaactccagttcaggaagttagcggctcataaaggatgagttgatttagagcctttccctgtgaagaagcttggaagagccagggttcaaagcctttgagataaaccaacaactgtgcccctgctgggaagtcattagtgtttgagggtcccacccattacttttgtaaagacacatgctttgtggacttataaataaaacttcaaaggtgatgacagtccagcagctgtgtagatggttgcatccttatgaactgtggacagaagctgaagtgggtaggagtcagggcaactttctggacagcagattaaacctgtgagtgtgttgctgatttcagtgttaactgtagcaccaatgagaaggtctcaagttttccaaagtgtgagagaggcaccatgaattagtggagaaaactgggactttggacagctattagctgttcttttgtataggcaaattaactctgggtaagtcacttctatgaacctgtaaaaacagtgataacgatatttatttcagtgtttgtgaatattaaactatatgatagggcctaatataatgcctggcaaaaaaggattcacttttagggtttccctgcagttatgtcagccagccattaaatcatatgttagagcataactctagtgatttattctcagggtgtaatataataataatgaacatttattgagtgtttcttatgtgccagaaactatactagctactatgtaccttactgcattcactctttgcaataagccccagttgtatcatccccattttacagataaggaagctgaagctaagagacaggctcagtaatttaccctagttcacagagttcgtgagttttagagccagaattctctcctaagtggtctgaccctggagcacacatatctaatcacaatattatgacatatgtggacttggtaggtgaggacaccaggactgtggctttgcactgtgaggaccactgtgtggctggggtcaagagcatggaagggaaccactttggcatctggtgggtaccattttggcatctggtgggtttataggtttgtgaacactaggcatacaatttaaggcaaggaattaggatcttcatggatgggcttggggctgcattctgtgactttaagtgtagtgtaaagggtgggcagagaaaaggccattggaggactgtctgtggtcacatgagtgacagctaaaaaggtggcacaaaagaggcattgttgaagttcttcattattcaaatcacaacaagccagttaagggggaggtactattatcactgacatctcatgtgtacccataggctgaaaactgtaagtttagattaaatggtttttattactatatatatatttttaacaataagaagcatctctccttctcattgtatgttctcactgtacgttctcatggaccagtgagaacactgggctgagtaactcaaggaggctggttcactctgtctgtgtagtcttattttgtcacagtagctgcaaattaattgcttttattggaacaattaaaattttcttataatttagcctttagtttgagaaagagacttggtttattctttttccctgaacttgcatttattgataccaaagatatgcctgatcagatggatatcaaacatctacttaggcctattgctataccagagattgtgcaggatatgaaggaagtgcaagccacaaacctgtctttaagggcattttaagcttgatgaaaaaacaatcagaatactactagctgagattaattgctgttttagggattaagatcacatctaacaaaatggagttaattgaaacactttatgtggaaactcatgaaattttactggcaaaattattttaacatttacatgtctgaactcttgacatttgtatgtcagcctaactgaatgtttatgagcagcaagtgatggttaataacgatttctccaaaaaggttgaaatgtttgagagagatgaaacaaggctcttttaaaatttaacacatttgctaatagctagatgagaggataaataatacataataaaagtagcaattgaaaccaatccgtgatattgagaagcaaatggtgctgcgttgcctttatgtcacctcaggaaagtcatttgatatctttggactcagttaagaactagaactttaaaaaatgtgtattgaaagcttattatttcctagcatttgcgaacagatttacttatgtcatatcatttggtttttacagtaaacctctaagatatattattataatctgcattttaaccctgaggaaattaaggctcatagaagtaaataagcctgcccaaggttgcatggctactaaatggcaaacccagaattctaatccttgattccctgacttcaaaaccaatatcttgtttatcttttatttttagttgtacatacttatgggatacaatgatatcccatatccagaatgatacatgtatacaatgtgtagtgatcaacttagtgtgttagtctgttttcacactgctataaagaaatatctgagactgggtaacttataaaagaaagagattgcattgactcacagttccacatggctagggaggcctcaggaaacttacaatcatggtggaagacaaaggggaaagaagcaccttcttcacaaggcggcaggagagagaagagtgaaggaggaacttccaaacactaatgaaataatcagatcttgtgagaattcactcactatcatgagaacaggatgggggaaccacccccatgatccaatcacctccctccctcgacatgtgggggttacggcttactccctcgacatgtggggattacaatttgcgataagatttgggtggggacacagagccaaaccatatcattctgccctgtcccctcccaaatctcatgtcttttcacatttcaaaaccaaccatgccttcctgacagtcacccaaagtcttaactcatttcagcattaactcaaagtccacagtccaaagtttcaactgagacaaggcaagtcgcttccacctatgagtctgtaaaatcaaaaataagttagttacttcctagatacagtggggatacaggcattgggtaaacgctcccattccaaatgggagaaattggctaaaacaaaggggctacaggccctatgcaagtccaaaatccagcatgggagtcattaaatcttaaagctccaaaatgatctcctttgaccccatgtctcacatcttgggcatgctgatgcaagggtgggctcccatagccttgagcagctccttcatggactggcattaagtgtctgtggcttttccaggtgcatggtgcaagctatcggtggatcaaccattctggagtctgagggacggtggccctcttcttgcagctgtactaggcagtgacccagtggggattctgtgtaggggctccaaccccacatttcccctctgcatggccctagctgaagttatccacaagggctccaccccctgcagcagacttctgcttggacattcaggcatttccgtacatcctctgaaatccaggcggaggctcccaaagcttgactcttgtcttctgcacacccataggcccaataccatggagaagccaccaaggcttggggtttgcaccctctgaagcaactgctcaagctgataccttgacctcttttagcagtggctggagctggcgcatctgggacacagggcaccatgtcctaaggctgcacacaacagcgggggccctgggcctggcccataaaaccatttccttcctaagcctctgggcctgtgatgagaggggctgcaacgaatttctctgacattccctggagacattttccccattgttttggtgatgaccattcgtcttctcgttacttacgctaatttctgcagccaccttgaatttctttttggaaaatgggtttttcttttctaccacatggtcaggctgcaaattttccaaacttttatgctcttcctccctttaaaacataaattccaatttcagataatgtctctcaagttcaaagttccacagatctctagggcaggggcaaaatgctgccagtctttttgctagagcatagcaagagtcactgttattccagttaccaagaagttcctcatctacatctgagaccacctcagcctggacttcattatccatatcactatcagcattttggtcaaaaccattcaacaagtctctaggaagttccaaactttcccacatcctcctgtcctcttttgagccttccaaactgtttcaacctctgcccattacctagttccaaagttgcttccacattttcaggttatctttataacagtgccccactctactggtaccaatttcctgtattagtccgttttcacactgctataaagaaatacctgagactgggtaatttataaaggaaataggtttaattgacacacagttccatgtgactggggaggccttaggaaacttacaattatgacggaagttgaaggagaaacaagcaccttcttcacaaaggtggcaggagagagaagagggaagaaggaactcccaaacacttataatgagaacagcatgggggaaactgctcccatgatccaatcacctccctttctcaacatgtggggattacaattggagatgagatttgggtagggacacagagctaaaccatatcagttagcatatcatcaccttgaatatttgttatttcttcgtgctgtgaacattaaaattcagcttttctaccaaagctaatatttttaaccacttctcccatgtatttcctgaggatggtagttgggagtaatgtgggctttttataggcagcaaacctcaaagacagggttccaaaattctgaataatgaagatttgatgtcactcatctggaggtgaatgaagctgtttctctggtcagcattagcccccttgcaaacatcccacaggtgcacatgttaaatcccatgccctgagctcagccagacatggtggacagaggagactcctagcactagaagtagaatccagtgagaggccatggctgtgcagtggtgaactacttagccaaccatctctccgctggtttgccgtggcctttcaactcagatggattacatctttggccagaagtacttttcagcctctggtgtttcttaattcagtagagtatttcacaagcttaagagttagaggcataatcaacatgtctcaaaatcaattccctccttcagaggctactgactggtttgtttacttttggattctgcggattaaacaccatttcaaatagttctttgagggtttttttttttccattctgtgcttttctctctctctctgcccttctaattcttccaccgtatcatcaaatgtacgccttttctgttccttcttgttatgacctttcttcctggtggtctctgagagctagtgttgagtgactttgtgggtgccatgtcataacccagattcctgcactgagcggatttcctcatggcttcttgaatggagatgtgctgaaaatgctaagtataccatgcaggtatttgactgggcttcccatggacatacttcaaaccagcagtctctgagctcttgtggttcacactggtattcaggcctgaatacaaatcaggcctccatgttcttcaagaggtgtcagcattcatgaaagttgaatatgagtgagccactcttatttttataatttcatttaaataatataatttattatcataaatttacatgttactctactgcaaattaagccataccaggcttagctccaagcacaaagtataccccttgtgaatattattcttttcatagagactcttaggaaggacatagattatatttaaatattttaagaagtcatttattttcagagaattcagggacttaaccactgtgatatttgtccagccttccctaggtcctacaaagcagacaatgtcaggctagatgggatagtgcagttcatttatttattcatcacatttatattgagtacctctgtgttccaggcgctgttgcatgttagagtcgggggagagtagagatggactcaggccatgccttaactacagattatgtcacttgactccacagcagaggccaggtgttcagaagtaaacccacttagcaatggacacagggggaaatgtcttctcacagagtgactggtttgacactgaggagagatttaggacggaaacacaacagagcctgtggacgttctggctactctgggatctcctgccttggggccgcctgcctgaagccacatctgccctcttacttaggactgggggttcctgcaggtgctgccacccagagggccaccagagggtgctttcctcttttcaggttatgcctttttgaaatgcagctcctcatactttttaaaactgagcttcccaggccctggaaagttcagtacattgcactgcaagctgaaagacttgattctaggtgagagaaaggcacaatctactgtgtctatatttctgtgtttttttcaaatgtctgtctccaatgactgtagtctgaagacaaggtcttgtcttggtgctcctccctcttccctgggattcacttcaagtttggcacatgaggggcccttcgtaaatatctgtgagtttaaagaaccaatttgactgcaagtcctaactccagttttcaagtgttctgaccatgagaatcatccggggtcaacccgccctgagattcttacccagtaggtctggggcggggctgggaatgtgattcagggaagaagccctcttgttctgacttgaggactgctgcccagctgttcctgccctgctcatggctgctcaagggtaagaaacacatccctgcttcctggacctgccactgagagcccttcaatgtgacccagccagccttccccccctccccttcctgttcctcttctcatgagcatctcttcctgtcacccagtgctacaaggggagggaaacattcccagagatgccttcacctgctggtcctgagagggcaccagggaagatacctccaacataaccaggtcttggttaccccccaccccacagggttgacctcttctgcaggctggtactcagggtgccacctgcttcagtgacacttaaatacttaaatgaacatagatgctagaagccactctgaagttgaggagggcctgcctcatacaccagagacttataatattgcctcctaagaaacctattttccagtcttttgagaagaagatgcatgtgcatcatgatgactttggtggagaataacttttgataaagaggactccttttgttctgtggtttggccttgctggagtagtgttggtcatatgaagagcttgggactcagagtcaggtggtgctgcacaaacctgagtgagtgtgcacttcattgagtgtgtctgtggacacatcagttaacctctttgagtcttatttttttcctaccagattagagaacaatatccacttcacagggttatatgtagacttgcttttagttagttgtaaaattgtcagcttatattcaacgtcaatataagaaatagcttttgaaatgtgtatttgaaactctatttatggatgttgtggagggagttgttttgtccatcatgtatggttcctctccactggagaaatgcttatttggcctttataccaggaatagcttcacatctcttgctgtgctttaatcttatggatttggtaatttgcataactgactggttttctttgtttgaactagctgctagaaagcctagagccaagtgtgcggttcatcagtatcaagtgtgcatgtcattatgttatacatttttggcctcatacatggatcagtttacaccgttgcaatttttaaaaaaattgctctcactttttatttattgtattttgtgtagttaagtattcctctaagctgcttttatctttctgaaatgagataggataaaataaaaataaatttgttaccaaataaatgagcaaatacatttaaagcagttttcacagtgcctggccaacagtgaattatataccacaatggttagttttaatcttccttgtaaatgagcctaattatcctctgtggatcccaatttgcccctcatggattatattataaagggtgcggtaaggtgattctcacaaggacaagtttcccaacctggaaaggtgttactgcattaggtcatagcaggtagaactctaaaacaagctgagagcccaaatggccaatctctgcatggaatttcctataaatatgcccagcctaaaccaaacgtaatttaagtgattttaatctttacacaagcctctcaaaacacattaaaggagaacttgttcttatctgccagctatacatcataaaatcttgtttcttctcctttctaattctctttgaatcactacttcccaacatgtctactgacatccccccttgtgccctgcatctcccagctctttcttatgtagactgacctagcttctctggttagtctccctgttttctcacacctctctggacttcttacccattctctgattctgtatcataaaagatttacgaatgggctgacaaagataattctacttgtgggtggattggggcattttcacatgctaataaatctttgctgtcatctaggaactaaagggcgatgaatgctgtgtggtagaagaggagagaactctggcatgtggctttatgtcaggagtacacacttgagctatgggatttggaaagaggcatgttggggcaaagatgacagaactttgttcttctggtcctgcctctatccaggcttcccttgccccaggataggggactttatggagaaggtaacctggaagtggagtcacgatgcgtttgtactgaatagggctgaagggattggtgcaaagttaggggataatgacggagcgaatgatccatcctactcttggcttcctgtggactgtgtgggaatggccatgcagacttgtctgccctctgggtagaggaaggaggaaagaaacagtctcagattcattagacacaatttcctgatgaaaatggaagtatccatatactacttgtttttttggtttgagaaatccagtaaatattaggttgatgcaaaggtaattgcgattgttgccattacttttaatgccattacttttaacggcaaaaaccgcaattaactttgcaccaacctaatagtatgtcaatgtattgcaaacctatatacttatgtgtgttacatcaactttaggatccctgatcaagtctttggtgtaaggatcacacttgaggctgggcttggtggctcatgcctgtaatcccagcactttgggaggccaaggtgggcggatcacttgaggccaggagtttgagaccagcctgaccaacatggtgaaaccccgtctctactaaaaatacaaaaaaattagctgggcatggtggctaacacctgtaatcccagctgcttggtatgctgaggcaggagaattgcttgaacccaggcagcagaggttgcagtaagccaagatggtgccactgcactccagcttgggtgacggagtgagtgagactccatctcaaaaaaaaaaaaaaaaaagggattacacttgaacagaaatagaaccagagacaggccaaatcagaagatagagccacaaaattattgacccagtaccacaggattaattgatataattgctttgaggccaggtgtgggggatcatcccagcactttttgaggccagggcaggaccgcttgaggcaaggtgttcaagaccagcctgggcaacacagcaagaccttgtctctgacaaaaacataaaaaattagctgggcatagtggtgcctgcgtgtagtcttagctacttaggaggctaaggtgggagaattgcttgagcccggaaggttgaggctgaagtaagccatgattgtgtcactgtcttccagcctgggcaacagagtgagaccccatctctaaaaataaataaataaataaataaataacaaaataaaaaattagccagatgtggtagtgggtggcctgtagtcccagctacttgggggactcaagtaggaggatctcttcagcccaagagtttgaggctgcagtgggctatgattgtaccactgcataccagccagggtgacagagtgagaccctaattctaaaacaacaacaacaacaaaaattttgaattgaatggatgggttttgccctctcattttagatcccattctttttttcactgaatatttattgagtgcctattatttgccagttctgctaagtgctgaggacattaagatgataaggcactggccctttccttgtaggagctatcatgtagatagtaagggagacagacattgtgaaaaaggataattagaccacaatatcttccatgccatcattgaggtatgaagagaatgcagtgcgacccagaagatggagtgactgacttgtcctaggaaagtcagggaaggagggaaccctggggctgggatttaagcataaggagtttactcatttgctgaagttttgtttcccagattttagtttgatcacactacctcataaatgttagaaaacatcttctggccaaatatggtctcagcatttgttcttttggttctgcaattagtgacagaccatagtaccatagtagcatctctggaatgttcttctgagccgaagaatttaaaagatgtcatacataatcagagataaactgcattcttgaggcttagcagataaatgctccaatttgttaagaagttttatgggagactttcattttggccacccagtatttacttcctgtggcaataacgccatgttaaacaaattatgaatgggaaagatgatcattctgaaatgggaatgtagaagctctaggtctgggccagatggatagaagctgctgtcacttggtgttgggaatgatttggactctgcacacacagttgggattcccttcaaggttattggactaccttagaccagaggtttggcttgatggttatgtcaccatcaccagcgggaagggcagcatggtggcaccgtctctcagtggccttcccgacgcctccaatgcgatttctgttcatctttaaagaaataaagtctgatttagagctttgtatttctttcttagtgttcgttataaaagtgaccattaaatatgaggttttagtgactaaaacagttggaggctacagctgggctgacagctttagtggagagtttattttctttctttttttccctcctgcctggcttcagctttaaattagattgtaataatcataacaaagcttctccctgcccttagttgaaagcacattgcagacctgaactctttctgagactttatttatgacggaatcccacaccattttagagctttcatcttccatgtgctcagcattttatgggtctccgttttctgtagcatttctgaaaccatggttcaaaacaatgtcaattccctcaggcaccagaaagatctaggaagagtgtgtcccgctctcctcattgtttgcatagatgtgttgacactgtcattgtgttaactctggaatacacagtaaagtgggttagttaaggctttaactaactttgactagtatggctttgcagccttatttcctgggtatattcccaacttaggtacttattagctgtgtgaccttagataccttagcaaacgtttctgtattacatcttcctagttgtgaagagagaacaatggtagcactgacctccaagagtggttgcgaggattaaacgagtactttcagcacttggaagaattctttgcagcagtaagtgcttaacaaatgtgagttgttggtattatcccagaagttcatgaattgatgaaactggatggtcgagtagtcataaaataatcctcctttacttggtctgcttgtttgtgcttgctaatggtatggttagaagattttaaaggttagacaaccacagtcaattggtggctacactgaattatcatttcctggagacagcaggaggcagtgtagtttagctgttaagagcattgggtttggagtcagaaagcctagtcgagcatcagttctgtttcttacatggcctcttagtggctcagttccctcatctgtaaaatggagctaattcctcacaagaccttttgcaagaaaaatgtatgtgaatgtctggagcacacattaaatactcaaaaaagttgttgtgggtgaggggaggagtgaggggaagagagattgatttaaggtcagatctgtttgtttatcatgagttccctggtaacaagcaatggagatgggagtttgctcagagccgtcagcatccagctgtgaaagggaaacactcaggctcttttaactttgagaatgttgacataaattacaaaaccaagaaggacaaatggcaatttgctgctgtcagtattataaacatcagtgtgagggtggacagtttagctcagatgagtcattccgggtctgtcctgtcttgtccagaagcttcacttgcataagatggggtaccattggcagaggaaagaagcaagctaaggacccagtctgtcttcttactgctggaaatagtggcagtggctgggctgtcccagggtttattcactgttacaaggttctgaaactttagggggtataaaactcaagtggggaacttgttaaaagggcaccttccaaagccttattcacaaacatttcaattcagtaggttgttggtagggcccaggaatctgcttgttttctggctctctaggtacttctaacacaggtgcttagaaactacactttgaaaaagacaattccagtgagattgggcagagtaaagtttccgtgtaggaggagctgcctctgccaggcttttccccagcattatggtttgcttctaaaaaggaagcaaacaaccagaaaacaaaaaagccaaatttgctttattttgagtcaaagcaccacttaataacttgtgtcaattgtttctcacaacactgcatgaaagacttaatattaattccatttgacattagaggagtcggggacttttggtgcaagcatgaattagaggcaaacattgcacaggttcttcagtttgtctccagccatctgggtattgctaaacacatctgtttcttctcttggagaggatgccccagtgttgtcacatgatttaaattatggcaagagtggaggttccgtttgtccacttccctggtttgcagggatggctcgggggagccttgctttgccgtgactggcattcatccagggcccgggcatttaactctgaattttgatttgggcatttgcctggtgtgatattctgccagggccttcccagtctgttctctgctgttttgctcctgaagatttatggctaatgaagggataaagaaaggtcgtggcgagaggcggcagcatgtggtggtgactcatggtctgggcctggtgtggagccagtttgggtggaacgctccactggctgctgtgcctgttttcacgtggctctttgccacagccctgcaggaggcagtttcttgcctgtctctggtcagagaggcctggtgattctgcctgtctcctgctgttatggactcaggtcagggcactaaagcctggcggccttttgacaaacagtctcacaaatgggagctcaggagacagtgggatgggccggtcctgggaagggctccaaagccactccaacgtgggggacacagtagcagcatgggccgaaggaagtcaagtgaagctactagcaggacagggtttctcagccttggcactgttgacattttggacaagataattctttattgcggggctgcactgtgcattgtaggatggtgagtggcatccctggcccctactcactagaggttagtagccccacagcccctctcagttaatgcaaccagcaaaatcacccctggttgagaaccactgtggtaggttgggttccaggcatgtggccagggttaagaagatccatccaccatcctgtttttattgagtacttaccacgtggcaggcattctttgcattcattatctcatttaatccccataacaaccctaagatgaaggaactctattgctcccattttctggataagaaaactgaagtttataaaagtaacttgcccaaggtcacatagtgtggggctcatatatgtgtcagatgccctttcctcaccctgtggccatatgtaatgaagccataatatggaagcctgggagaaaagctgcaatgcgtgacaacagctggcatgtagtgtaagggggtgctgcctgttgagctccagggctgagattgaggagtctaattacaaaccctgtggagatagttaagggcttacatgaacttgaataccaggtggatgattcagatagagatggagctactggaaatgccatgtaggttgggggttggttgcaggtaaacttttacctatgcccaactgttgtccctcacttgttcatgacactggatcccctgagatatgactcctgatgtgagcccaaatgtgctttttccacttcaaatactgctcattggactggggtctctcaccccaacctccattcctccttagggaccagcccttctcttgcctgaatcttagcttcttccactgacaccacgctgccttgggttgggacatgcctgagctatgacatgtacattgaaatgactagacaacacgaggttgctcgtcacctctggcacagtaaagaccctgggacatgacaactgaagctggtgtgatctccagtgcatgtaaaatacttgtagtttataggaactgatgattctgaattgaatgccaatccttgggaaggtttttaaaaggaaagatcagagtttctgatattgtggtttcctcaatatcaaaggcaccaggtggaggtgagaaagatgttacctgaaatccaggtgagcctcttcaatgggctttttaaggatgttttcccattagtggggcaggacaggttttggagtgcatgattactttgtagtctggctgatatctagaaccaaatgggcttcaatttggaaaatgacattcacagatagcattagcttgaattacatggatttctcctctatttacacccaattaattagcacttaaacacatgtgcaatgtgaatactgggaatacctttgcaaaaaggaaaattctgactgagttgcaaagcctgcttgggacctgcaattgtttggggggtcctactgctcatggacctgatagacgctgatgtcccacagagccttctcagtgtgacattttgctcagcacagtcactatgcaggttttagcatttctgcaagactgtgaaataatctctgtgattcccctgtgttcttaatcccttttgctcttctgtggtggtcttgccctttctcaagaatattatcgttggtacttgttggttcaagggggtgtcatttgaaggaacatcatataatatagcaagactgctctctggaaattttttgcttttgctcactctgtttttattcttattttgaatactagaaaaataatatatgtttatggaagatgaattagaaaatacaaataatcaacaaagaaaaaagaggaaaaaattaccttgtaatcatgcaacccagatatagccattattaacattttggttatgtccttgtgtttttgtttcacttttaacaaaaggagaggatagaagaaattatcagaacacatgtggcatttttttagtagaattttaaaaaatgcttcaaaaaaccttttgatttattggcaaataggtcctgatgactgtcaatgatgtacacagttttggaaatatactaagaaatgccatattagtctccttgctgataaagggtatatctataagagaagtgtgtgtgtgtgtgtgtgtgtgtgtgtgtgtgtgtgtgtgtgtgtatgtaaatgaactctctgtggctcctgaaaaagaaattctgttctggatttgttgactcactgccaagctctgctgcaggcagggagcagattctaagttattcaagccaaatattttcgccctcatggtttattggctactgtgacagacttctcctcacacctcacctcctcactggcacgtggacatatcaggcattttgttcattttgcttctcgatctctccctatttctttcaattactccttagcatttcttgaatttatacgagtaccaccccaactcgctaatacacgttagaaatacccagacacttccttcttgaggtcgctgcaggaatccaccgtctccctctaagactttgttcatgtgtgagcctccttagggctcctaagctgttatgagggagcagctcctctcagggagggagcaccactcaccttcattcattcacagtcactcagaataacactgtttcctttccatgcccaacatgagatcagggtgtatgactgaactcaaggttcatcacacccttagggggacaggcttggggggatgagagagagagaggaactgtgctgcttcagtgaagaactcctcactctcctgggtaaaagagaattttgtacaggctgtcatgaccagtaagctattgctgagaagatgcatcctaggatgatagttttaaaaagttaaaaaaagaaatgtttagctccagttggcaaaaaaaactagacacaggaaaagatagtgtagcctgctttaaaggatcacaaagtatgaaggagactggatgggtaagggctttatatgaagagcttgctttccagctccatggtgtttccctccttctgctttcagtgtttttggtgtgttgtttgaaatgtttggaaaagatcctaagtcaaaatgaggctaacggtaattgctttctaagttccaagcgctgttgtaagcactgatcatgtagtcactaatttaaaccctacaacaacctcaggggaggatccatcgccactgttttacagacgtgaaaacgtagtacaggctttaagaaacctacccaaggtcatacagctggtaagctgcagagccaggattcaggccaggaaaccacactctctgctctgcctcctcttgcaatgaaagtggccataggactctgagttctagtcagagctctgctaataatttgctgtgttatatctttgggcctcagtttcatcatttggctaaaaaattatacaatcctatagatatgtttatgctattcccctccccactcctacaaatcttgaatacatctagagagataaatgcaatttgcctcaaatgaaattcagattgaattttgcatcttgctccttcctcttttggtcttgattccactttctctgcaggagagaattgctgtactgcagtccagtcactgttataagcagagacagtttccttggagcagctgacctcattgggccagtcctatttagtaataaagaggggtttgttatagctttcccatgaaaagatttaagaggagcaattcagagaaatggaaacattcttaattagcaagcacatcatctcaagtttccaagattttttaatccatagagcagagacatgtttaaaaggagagacaatatggtttgaaggactaagcaccaaactgaccgagggaaatgcctttatcctactgatttgccacatgttcccaacaagtcatttggccatttaggcttctgtttccttggtgaggttgctatggtaaggcctgaagaatcacctgtaaaactcgctgcaaatattgacttctgatgatcttgttcaaccttgggaggtaaggtttctcagcatctcatctgtttgtatgtctcctggaagccttgcaaccctgaccctactgatagagcccagctgttgtctcttacctgttcatgacacccaccttccttgttaactgtctgatgataggctcaacggagactgaggtgtttgtaacaagggtgatagcaaacatggagcatggtactattgtggtgactttgtactgactcatcatcatcaataaaataacttacttcgtgaggaactctgcacatatttcctaacatctagttctgttctaggggttatcttaaacttgggaccaactttctaattttttatctctcagggtgaaatgcatccctttcttctttatcccatgcataggtaaacattacccatagtcatgttctagcttttagaaaaaaaaaaaattctagtctgaattttctctcccattctttaacagtatctttgttttctggcttttgctccgatattccacaattcactcttgtctctgcttctgacctttactggtgctgcctcaagactcagcttccattaaatgagatcatttgttctatatttaactgaatattaaaaagacaatgggcctaggaggagaacaaaactttgccctaatatcggagaagctgagcacaaatatggtgctcaggtggaggggtaggggatgatgccagaatggaagatcggaatcagattgcaaaaagtcccctatgtcacattgagaagtttcaattttaagtttaaaacaacaagaaattcatagaaaacatatatatgtgtattcacatgagatcagatctcttgtttaaagaggttcagttcgtagttcaacagaaatgtttgataagcaccaattttgtgtcagggtctatggtaggtgcttaggatacaaagatgggtaaaacatgctcttactctcaaggaggagatggaactacaacatgacaaataatagtacaggaggagtcaagattaatttctcagtctttatgctaacagaagtttttaggcagaagaaggacaatgtttaaaagttaaataaaaatagctctgctggctgggcacagtggctcacacctgtaacctcagcattttgggaggccaaggcgggaagatcacatgagcccaggaatttgagaccagcctgggcaacatagtgagaccctatccttatattattaaaatgataatttttaaaaaagttctgttgtcagtgtggagggtaaactagacagtagaaacagggaaagtgttgaatgtaaatttccattcagtgttagttgtcttcattataataatgattatcgtcaacttttgtccttttcacatgtgaaatcacactttggggactcttacctaatacatttctttctaaaatttagtaactggcacccatttggacagataaaacacaatgatggtaccaagacagcaagacagttggtgaaggccagatttgctttacataccaagagttcttgcctgtttccaaatgttttgggtggatgtagtttctttggaaattgtccagctaaggcttcttatgaataaaaaatgttgctctaattaaaatcattcaggcccaagttacatttttccaataattcacttgtgatttataattggagatatatacaatatcaaattacctaagtggggagggggagggaggaaaagaaaactaagctctgttgtaagaatcagttcagaatattgctgacttcataaacgaaaccactcaggctttctcccaggcagcagttgatatatttatagccttgtaatttggttacttatcacttagcttataagtgagtcacccatgaaatacatgcacagagaccaaacgtgctaattacaaaggtagagtgtagatgggagggccctgttaggacccctgtttaatagcagtggcaaactgttgggaaaggatcatttatcatgaaatgacatgaaggctcaaatggcagagctttcgagtctggctttaaagagctattcagctttgctcctgtcaagtgggactccttgtctcatcatcactgccttccagtttgatatgctgtgtttgtttcacggaggggtgatgggcgggcagcagggagggagagcggtgggaaggatggtaagggaggctcagggcagggaatagctgagctatttgagaggaagtgtttgtgttaacttactttttacttcagaagtgacattctgacagagctgtcagaaattacatttatttattttaaaatttccacattatttttttcctgaaatgatttcccattccagactctacctggtgaaatcttgttcatctctcaaaactcatttcaaaaccgacttcctccatgggaactcaaaggccttaaattttctttcaagcatatcctagcatattaaatttaaatggaaggtgctacttttaggtgtaagaaaaatttcaagttatcagccaacacattgtcctatatcaaacaaaggtatatttaagcttatttcatcaattatttccaaagctttcttttgtgactaaaattgtggcttcacctagcattaagaagaatgaattaggcggggcatagtggctcacgcctgtaatcccagcactttgggaggccgaagtgggtggatcacctgaggtcaggagttcaagaccagcctggccaacatggcaaaaactgcatctctactaaaaatacaaaaattagcctgtaatcccaactacttgggagtctgaggcaggagaatcgcttgaacccagggggtggaggttacagtgagccgagatcacactactgcactccagcctgggtaacagagtgataatccatctcaaaaaaacaaacaaacagacaaaccaactaacccgaaaaaaacccaagaagaatgaatcagttactttcaggaccaatggcattctttcattctttcctccccctatccttgtccttaaaaacaaaaaacaaaaaacaaaaaaaaaacagatattgggaaattttcttaagcaaagttatgtattcaaaaaccagctagacctggaaaattaattcactctgctctgaatttggatgcactcttttatctctcgacttaactctctgagtggtccattttatctatggaaatctagtttcaagatgttctggcagcaaagaaactcaaagccagattaattgctaaattacaaacacgaagccacagtatttaaaagcaagcttcacacaaaataatgttttcatgttatttaaaagatatactccaagtctccgtttggagattggatggtttaatagatcctaacatgtacagagggaaaactacccatcagtacttggatactcttgtgaagctagagtcatatctgggcacagggaggatgaagtctctgtggccagtgctgagcgtggttgctggcaggttttggtaacagtgattcagaggctgctgttgatcactgggagatatctagaattaccgccaatgcctgacttcagggctcttggattggaaagactcaggcgcatccaaaaaactcaccccactgtaccctcctccacccacattccttcattgcacaaaaaaagacatcatttgagacttaggctgaaattgagatgtcatttcttcattcattaattcattcaagagatagttcttagatgtatattgtattctgaatactgtgtgaggtggaaaaaaagatctatttcaacaaagctcctctcctatccaggctagtgtggcatgaattattcttggtgagcatataaggggtcctagagataaatagcagctttttctgaactactaatgtatcatttgaaaaatgattttttaaaaaatttaagtaattcataaacatggtttaaagcatcatgtagtgtggaagggcttatactgaaaataatcattattctgtcctactcctcccttctcagaaatcctcacctttaaccatttctgctttcttttgttggtaatgcctgtaactttaaaaacatgcttactatgaattcttggttcattcattgtagacactattgtagatgagaattttgctcattctccacccccatctctcttctcttttgtaatataatatcactgtttttagttcttctaaagttaacttttgtaactcagaataatgtacttaaactcctcttttttgttcaatcagctatgaacataatctcttgaccatccactttgtaggataaggatattcatattcctatcctttctgccactttttaaatgcctcctcaccttctcttttttctcagctgtaattttgccttcactgtgtcaagttgataatatttacactttgtctgtaacataattattttcaaaagtcatataaaattatccattgtagaattttctgaggacttatgtcaagctcagtggatcattatttccagagttggaaagagcaactctgaaaaattggagcagtgttctggcctttcttctacagattgtgattcctcacaaggttattaatgatggtctgagctcaaacctgaaagtccttttatttccttgcattagaaatgtgtctggcttagagttttgagttaaagttgcttgatgatctttgctattttctcacccaatcttcttaggcagacctcattttcctcttagtatttccatacttcagaccatccttggtggagaggaatgttgccaagtccttttaccatcttctacctctgttatagtgataacactataagactacctctgttataatgataacactgtgccatattccccagaggtacccttcccttccttattcatcttgtccaaacacatctttattttttatttgcttatttaaaaaaattatccaaatacttgtttttgatttttgagtttaggttcatggggtacatgcacaggttcattacaagggtatattgtgtgatgctagggtttgggcttctaatgatctttttgcccaaatagtgaacatagtacctgagaggtagtgtttcaaccctttccccccccatctccccttttgagttcccagtgtctatcgttcctgttgttatgtctgagtgtacccaatgcttatctcccacatataaatgagatcatgtggtatttgtttctctgcttatatgttaattcacttagaataatggcctccagctgcatccatgttgctgcaaaaaacatgatttcattctttttatgtccgtgtagtagtccatggtttatatgtaccacattttctttatccaatccactatcgttgggcacctgggttaattctgtgtctttgctattgtgaatagtgctgtaatgaacatatgagtgcagatgtctttttggtagaatgattaattttcctttgggtgcatacccagtaatgggattgcttggttgaatggtaattctgtttttagtttttgaggaatctccaaatgctttccacagtggctgaacaaatttgcattcccaccaacagtatataagtgtttccttttctccataatcttgccaacatcagttttttttaaaaaatttcaataggcttttggggaacaggtggtgtttgattacatggataaattcttttgtggtgatttctgagattttggtgcatccatgacctgagagtgtatactgtaccccatgtgtagtcttttatccctcaccaccctgccacacttcctcccgagtccccaaagtctgttgcatcattcttatgcctttgcatcctcatagcttagctcccacttataagtgagaacatacaatatttggttttccattcttgagttacttcacttataataataatggtctccaattccatccaggttgctgcaaatgccattattttgttcctttttatggctgagtagtattccatggtgtatatatatatcacattttcttcatctactcattgattgatgggcatttaggttggttccatatttttgcaattgcagattgtgttgctataaacatgcatgtgcaagtatctttttcatgtaatgacttcttttcctctgggtagatacctagtagtgggattgctggatcaaatcatggatcgttctttaagcaatctccataccgttttctgtagtggttgtactagtttgcattcccatcagcagtgtaaaattgttcccttttcaccacatccacaccaatgtctattattttttgatttttaaactattgccatgcttagaggattaaggtggtatctcattttggttttgatttgcatttccctgatcattagtgatgttgagcatttttttgatgtttgttggccatttgtatatcctcttttgagaatgtctactcgtgtccttagcccactcttttatgggattatttgtttttcttgctgatttgtatgagttccttgtagattttggatgttaatcctttgtcagatgaatagtttgtgaagattttctcccactctgtgggttgtctgtttttttaaaacaatttattattattttatttttccataagttattggggtacaagtggtatttggttacatgagtaagttctttcgtggtgatttgtgagattttggtgcacccatcacctgagcagtatacactgcaccatatttatagtcttttatccctcacccccctcccactcttccccccaagtcctcaaagtccattgtgtcgttcttatgcctttctgtcctcatagcttagcatccacatatcagtgagaacatacaatgtttggttttccattcctaagttacttcacttagaataagagtcttcagtctcatccaggtcactgcaaatgctgttaatttattcctttttatggtgtagtattccatcgtgtgtgtatgtatatgtgtgtgtgtgtgtgtgtgtgtgtgtatatatatatatatatatatatatatatatcacagtttcttatatatatatcacagtttctttatccccttgttgattgacaaggatttgggttggttccacgaatttgcaattgtgaattgtgttgctataaacatgcgtgtgcaagtatctttttggagtaatggcttcttttcctctaggtagatacctagtagtgggactgctggatcaaatggtagttctacttttagttctttaaggaatctccacactgttttccatagtggctgtactagcttacattcccaccagccctgtagaaatgttccctgatcaccacatccatgccagcatctactgttttttgattagtttattatggccattcttgcaggagtaaggtggtattgcattgtgggtttgatttgcatttccctgatcattagtgatgttgagcattttttcatatgtttgttggccatttgtatatcttattttgataattatctattcatgtccttagcccactttttgatggggttgcttgtttttctcttactgatttgtttgagttcattgtagattctggagattagtcctttgtcaggtgtatagattgtgaaaaatttttcccaccctgtgggttgtctgtttactctgctgactgttccttttgctctgcaaagctctttagtttaattaggtgccatctatttacctttgtttttattgcatttgcttttgggttcttggtcatgaaatccttgcctaagccaatgtctagaagggtttttccaatgttatcttctagaatttttatagtttcaggtcttaagtttaagtccttaattcatcttgtgttgacttttgtataaggtgagagatgaggatccagtttcattctcctacatgtggctagccaattatcccagcatcatttgttgcaaagggtgtcctttccccactttatgtttttgtttgctttgtcgaagatcagttagctataagtatttgggtttatttctgggttctgtattctgttccattggtctatgtgcctattttaataccagtaccacactgttttggtgactatggccttatagtgtagtttgaaattaggtagtgtgatgtctccaaatttgttctttttgcttagtcttgctttggctatgtgggatcttttttggttccgtatgaattttagaattgttttttctaattctgtgaagaatgatggtggtattttgatggggatcgtgttgaatttgtagattgcttttggcagtatggtcattttcacaacattgattctacccatccatgagcatgggatgtgtatccatttgtttgtgttgtctatgatttgtttcagcagtgttttgtagttttccttgtagaggtctttcgactccttggttaggtatattcctaagtttttttttttttccagctattgtaaaagtggttgagttcttgatttgattctctgcttggtcactgttgctgtatagaagaactaccaatttgtgtatattaatcttgtatctggaaactttgctgaattcttttatcagttctaggagctttctggaggagtctttagggttttcaaggtaaatgagcatattgtcctcaaacagtgacagtttgacttcctctttacctatttgccctaaatttttctctttctgattgcttttcctaggacttccagtactatgttgaagaggagtggttagagcgggcatccttgtcttgttccagttcttagagggaatgctttcaacttttccccattcagtattatgttggctgtgggtttgtcatagatggcttttgttgcattaaggtatgtcccttgtattatgctgattttgctgagagttttaatcataatggatattggattttgttgaatgctttttctgcatctattgagatgatcatgtgatttttgtttttaattctgcttatgtggtgtatcccatttattgacttgcatatgttaaaccatccctgcatcccttgtatgaaacccacttgatcatggtggattatctttttgatatgttgctggatttggttagctagtattttgttaaggattttaacatctatgtttatcagggatatcagcctgtagttttctttttttgttatgtcctttcctggttttggtattagggtgatgctggcttcatataatgaattagggagggttccttctttctctatcttgtggaatagtgtcaaaaggattggtgccaattcttctttgaatgtctggtagaattctgctgtgaatccctctggtcctggacttttctttgctggtaatttttaaattaccatttcaatcttgcagcttgttattggtctgttcagggcatctaattcttcccaatttaagctagtagggttgtatttttccaggaatttatccatctcttctagattttctagtttatgtgagtaaaggtattcatagtagcctcgaatgatctttttatttcagtggtgtcagctgtttcatttattagtgaggttatttggattttctctcttcttttcttggttaatcttgctaatggtctatcaattttatttatcttttcaaagaaccaggtttttgtttagttatcttctgtatttttttttgtttcaatttcatttagttctgctctggtcttggttatttcctttcttctgctgggtttgtgttagatttgttcttgttcctctaattccttgatgtgtaaccttagaatgtcagcatgtgctctttcagtctttttgatgtaggcgtttaggactatgaacttttctcttaacaccacctttgctgtatcccagaggttttgtagattgtgtcattattgtcattcagttcaaagaatttttaatttccatcttgatttcatttttgacccagtgctcattcaggagaaggttatttaattttcatgtatttgcatggttttgaaggttccttttggagttgattcccagttttattccactgtggtctgagagagtgcttgatgtaatttcagttttcttaaatttattgaggctcattttatggcctaccatatggtctatcttggagaacgttccatgcgctgttgaatagaatgtgtattctgcagttgttggatgaaatgttctgtatatatctgttaagtccatttgttccaaggcatagtttaaatccattgtttctttgttgactttctgtcttgatgacctgtctggtgctgtcagtagagtattgaagttccccactattattgtgttgctgtctatctcattttttagtgattgttttataaatttgggagctccagtgttaggtgcatatatgtttaagattgtgatgttttcctgtgggacaaggccttttaccgttatatacacttttaactgctcttgctttaaagtttgttttgtctgatacaagaatagttacccctgctcacttttggtgtccattcacatgaaatgcctttttccaacccctttactttaagtttatgtgagtccttatgtgttgggtgagtcacctgaggcagcagatagttggttggtgaattcttatccattctgtggttctgcatcttttaagtggagcatttaggcggttacattcaatgttagtattgaaatgtgaggtaccattgcatttattgtgctctttgttgcctgtgtagtttgtttttttttgttttttgtttttgctttttaacttgtatttttgttttataggtcctgtgtgatttgtgctttaaagaggttctgttttgatgtatttccagatttagagctccttttagcagttcttgtagtggtggcttggtaatgatgaattctctcagcatttgtttgtcgaaaatgactgtatttttccttcttatatgatgcttcattttgctggatacaaaatccttggctgataattgttttgtttgaggaggccgaagatagagccccgattccttccagtttgtaaggtttctgctgagaaatctgctgttaatctgatagtttttctttataggttacctggtgcttctgtctcacagctcttaacattttccttagtcttaactttggttaacatgatgacgatgtacctaggtgatgatctttttgtgattaatttcccaggtgttctttgtgcttcttgtatttgaatgtctaggtctctagcaaggctggggaagttttccttgattattcccccaagtatgttttccaagcttttagaattctcttcttcaggaacaccgattattcttaggtttggtcgtttaacataatcccagacttcctggaggctttgttcatattttcttattcttttttctttgtctttgttggattgggttaatttgaagaccttttctttgagctctgaattcctttcttctacttgttcagttctattgctgagactttccagagcatttcacatttctaaaaatggccaaagtttcctgaaatttttattgttttttctttaagctatctatttctatgaatatttctcccttcacttcttgtatcatttttttggatttctttgcattgggttttgcctttttctctggtgcctccctgattagtttaataactaaactgaattcttttccagtaaatcatggatttcttcttggtttggatccattgctggtgaactagtgtgattttttcggagtgttgaagagccttgttttgttatattaccagggttggttttctggatccttctcatttgggtaggctctgtcagagggaaggtctagggctgaaggctgttgttcagatttttttgtcccatggggtgttcccttgatgtagcactctaccccttttcctatggatgtggcttcctgtcagttgaactgcagtgattgttgcctcttttctgggtctagccacccaacgagtctacccggctttgggctggcactgggggttgtagagggacctgcagtgggcagggccctaaaactcccaagattacatgccttttgtcttctgctactagggtgggtagggaaggaccatcaggtgggggcggggctaggcatgtctgagctcagactctccttgggtagatcttgctgctgctgctgttggggatggaggtgagattcccaggtcactggagctgtgtacctagaaggattatggctgcctctgctgagtcatgtaggttgtcaggaaagtgggggaaagccagcagtcacaggcctcacccagctcccactcaaactgaagggccagtctcactccaactatgcccccacccccacaacagcccagagtccgtttctgggcagtgggcaagaggggcttgaaagcttgccccaggctacctgcctcccagctgctaaagaaaaggggttggttcttcttctgtggaatctgcacatgggattcatgccctctcccgagttctggccagcaggcttcttgccccttgccccattcaaattgttacaaagttcagctagagatttccttgtccctgtggagtttcactccctgttcctctggccgccctcctgatgaatccctgtgttgccagcaggaatggcccgcttggggacccagtgaactcccagggcctttctgctgcttcctgtacccctgtatttcactccgctctccacattgactcagctccaggtaaagtcagaaacttctcctgcaaacagaccttcagtttctccagtgggggtgtgtgtttgggagaggtgggtctccctttctcaattctgcagttggggcattcacagtatttgaggtgtctcctgggtcctgcaggatcagtccgcttcctttagagggtgtgtgggtcttctcgggattgatgctttgttcttgcagttaatttgaagctaaaattcacagtgtgagtctcctcatgctgctctgtccagagctgcaatctagtcctgcctcccatctgtcttgatgatcaatatctgattgtctgtttactctgctgattatttcttttgctgtgaataagctttttagtttaattaagtcccatctatttatcattgcttttgttgcatttgcttttgggttcctggtcatgaagtctttgcctaaaccaatgtctaaaagggtttttctgatgttgtcttctagaatttttatggcttcaagtcttacatttaagtctttgatcagtcttgagttgatttttgtgtaaggtgagagatgaggatctagttccattcttctattaagtgggtgcaaacataattgtggtttttgctagtactttttaatggcaaaaactgcaattacatttgcaccaacctaatacatgtggcttgccagttatcccagcaccatttgttgaatagggtgtcctttccacactttatgtttgtgtttgctttgtcaaagatcagttggctgtaagtattcgagtttatttctgggttctctattctgttccattggtctatgtgcctatttttatatcagtaccatgctgttttggtgactgtggccttatactatagtctgaagtcaggaaatgtgatgtctccagatttgttatttttcttagtcttgcactggctctgcaggttcttttttggttccatatgaattttaggattgtttttctagttctgtgaagaatgatgatggtataatattttgatgggaattgcattgaattgtagatttgcttttggcagtatggtcattttcacaatattgattctacccatccatgagcatggcatgtatttccatttgtttgtgttgtctgtgatttccttcagcagtggtttgtagtttttcttgtaggattatttcacctgcttggttaggtatatttctaaatattttattttattttattttatttttgcagctattgtaaaagtgtttgagttcttgatttgattctcaacttggtcactgttggtgtatagcagtgctatggatttgtgtacattgattttgtgttccgaaactttagtcaatttatttatcagatctgggagctttttggataagtttgtagggttttctaggtatatgatcatatcattggtgaacagtgacagtttgacttcctctttaccaatttggatgccctttatttatttctcttatccgattgctctggctaggacttccagtactatgttgaatagaagtggtgaaagtgggaaccttgtcttattccagttctcagggggaatggtttaaacttttccctattcagtataatgttggctttgggtttattatagatggcttttattacattaagatacatcccttctatgccgattttgctaagggttttaatcacaaagtgctgctggattttgtcaaatgttttttctgcatctattgagatgatcatgtgatttctgtttttaattctgtttatatggtgtatcacatttgttgacttgtgtattttaaactatccctgcatccctggtacgaaacccacttgatcatggtggattatctttttgatatgctgttagattcagttagctagtattttgttgagaatttttgtgtctatgttcatgagggacatcagtctgtagttttctttttttgttatgtcctttcctggttttggtattagggtgatcctggcttcatagaacgatttatcttctttctctatttttttggagtactttcaatacaattggtaccaattcatctttgaacgtctgatagaattcagctgtgtatccatctggtcctgggcttttttttgttggtgatttttttgtcatcatctcaatcttgctgcttgttattgatctgttcagagtttctatttcttcctggtttaatctaagatggttgtatatttccaggaatttatccatcttttctaggttttctagtttgtgcatgtaaaggtgtctgtatagccttgaatgatcttttgtatttctgtgttatcggttgtaatatctcccattttgtttctaattgagcttattttgatattctctcttcttttctttgttagtctcactaatggtctatcaattttgtttatcttttcaaagaaccagctttttgtttcatttatcttttgtatttttttgtttcagtttcattaattctggtctgatcctggttatttcattttttctgctgggtttgggtttggtttgttcttgtttctctagttccttgggatgtgaccttggattgtctatttgttttctttcagactttttgatgtaggcatttaatgctatgaactttcctcttagcactgcttttgctgtattccagaggttttgataggttgtgtcactgttatcattcagttcaaagcatttttaaatttctatcttgatttcattgttgactcaactatcattcaggaatagcttacttaattttcatggtcttgaggggtccttttggagttgattcccaattttattccactatggtttgggagaatacttgatataatttctattttcttaaatttgttaagtcttgttctgtggcctatcagatggtctatcttggagaatattccatgtgctgatgaatagaatgtatatcttgcagttgttgggtagaatgttctataaatatttggtaagttcatttgttctagggtgtagtttacgtctattgtttctttgttgactttctgtcttgatgacctgtctagtgctgttggttgagtattaaagtcccccactattattgtgttgccatctatctcatttcttaggtctagtagtaattgttttataaatttgggagctccagtgttagctgcatatatatttaggtttgtaatattttcctgttggactagttcttttatcattatataatatccctctttgtcttttgttttgttttgttttgagacggagtctcactctgttgcccaggctggagtgcagtggcatgatcttggctcactgcaagctctgcctcccaggttcataccattctcctgcctcagcctcccgtgtagctgggactataggtgcccaccaccacgcctggctaattgttttgtatttttagtagagatggggtttcaccatgttagccaggatggtctcgatctcctgacctcatgatctgcccacctcggcctcccaaagtgctgggattacaggcatgagccactgtgcctggccctctttgtcttttttaactgttgttgctttaaggtctgttttgtctgatataagaatagctacccctgcttgcttttggtgtccatttgcatgtaatatatttttccacccctttaccttaagtttatgtgagtctttatgtgttagatgagtctcttgaagacagcagatacctggttggtgaattcttatccattctgccattctgtgtgttttaaatggagcatttaggccatttacattcaacattagtattgagatgtgaggtactattctattcattgtgctagctgttgcctaaatacgtttttttcattgtgttattgtttgataggccctgtgagatttatgctttaaggttttattctggtgtattttgaggttttgtttagcagctcttttaatgctggcttggtagtggcaaattctctcagcatttgtttgtctgaaaaagactgtctttccttagtttatgaagcttagtttcactggatacaaaattcttggctgataattgtttggtttaatgaggctaaagataggactccaatcccttcttgcttgtagggtttctgttgagaaatctgctgttaatgtgataggttttcttttataggttacctggtgcttttgcctcacaggtcttaagattctttccttcatcttgactttagataacctgatgactatgcacctaggtgactatcttttgcagtatatttcctgggtattcttcaagcttcttgtatttgaatgtctagatctctagcaaggccagggaagatttccttgattattctctcaaataatttttccaaacttttagatttatcttcttcctcaggaacaccaattattcttaggttcggttgtttaacataatctcacacttcttggcagctttgttcatttttttaaaattcttttttctttgtcgttgtcagattgggttatttcaaaagccttgtctttgagctctgaagtactttcttctattgttgaaactttccagtgtactttgcatttctctaagtgtgtctttccagaagttgtaattttttttttatgctatttcttttgacattttttctttcatatcctgtattattttttaagtttctttaagttggttttcatttttctttggtgcctccttgaggagcttaataatcaaccttctgaattctttatctggtaattcagagatttcttcttggtttggatttgctggtgagctaatgtaattttttggggatgttaaagaaccttgctttgtcatattaccagaattattttactcgttccttctcatttgggtagactatgtcaaaggaaagatctggggctcaaaggctgctgttcagattcttttgtgtcataggttgatcccttgatgtggtactctcccccttccccctagggatggggcttcctgagaggtggactgcagtgattgttattgctcttctgggtatagccacccagcataactaccaggctctgggcatgtactggggaatatctgcagagtcctgtgatgtgatcagttttcaggtctcttagccatggataccatcacctgctccagtgtatgtagcaggggagtgaagtagactctgtgtgggtccttagttgtagttttgtttagtatgctggttttctcaaatgctggttgtgctaggagtgaagttatcctgtgggcagactcaggacctctggtttgccaggatgttataggcggtggaattagctattgttttctcctttcttggaacaaggttgctttttttttgagttgctgtaatggcttgaattggttgacttccagtcaggaagtggtgctttcaagagagcatcaactgtcgtagtatagtggggatacaattttgccctgaggttgtctggataagtattcaggttttggctgggcacggtggctcacgcctataatcccagcactttgggaggccaaggcaggcagatcacctgaggttgggagttcacgaccagcctgaccaacatggagaaaccccgtctctactaaaaatacaaaattagtcaggtgtggtgatgaatgcctgtaattccagctattcaggaggctgaggcaggagaatcacttgaacccggggggtggaggttgcagtgaaccgagattgtgccattgcactccttcttgggcaatgagagggaaactccatctcaaaaaaaaacaaaaacaaacaaacaaaaaaaacgtatttgggtttctcaggtaatgagcagggccatagagcttccaagagattatgtcttttgttttctgctaccagggtaggtagagaaagaccatcaagtgggggcaggggtaggcatgtctgagttctggctcaccttgctgtggctctcagtgggggataggggtgtggttctcaggccaatggagttatgttcccagggggattatgtctgcctctgctgcaacatacaggtcaccaggaaagttggggaaaaccagcagtgacaggccttacccggctcccatgcagccagctaggctggcctcacccctaccatgccccatcaacagcactgagtttatattcaggcagctggtgagtagggctgagatcttgccccaggctataagcctccccactgaagaagcaagcagggctttcaggactcagtttcaaccctccccacctgcctcagcttctgtgcttatatctgcactttccgttcactccctctactcccaggaaaattcacgttcgatggaaattattacagagttcggctgggagtttccttctccctgtggtccttctccaattccactggcagccctccccaaggactcctgagggataaactcagaaatggccacccgggtttccctggcgaccaggagtacctacagggttcttcccatcttctacttttatattttgcttggttctctaaattcatttcagctataggtaaggttaaatcattctcctgtgatctggattttagggttccccagtgaagatgtgtgttcggaggtagactttccgcctctcacactttgggcactcacaattttttggctgtctcactgagtttgcagcaccaagctgcttctttcaaaggatctgtgaattatttcggtttttgcagtctgttcctgtggtagttcttggagcaaaagttcacaatatgagtctccacatgctgttctgtccatccaaatgaaacctgcaagttagttctgcctcttatccaccatttaaaaatattttttgactttttagtattagtcattctaacttgtatgagatattgtggttttgatatgtatctctctaatgattagtgatgaagagcattttttcatgttttttggctacttatatcttttgagaagtgtctgttcatgtccttggcccactttttaatggggttgtttcttttttgcttgttgtttaagtttcttatagattctggatattaatactctgtcagatgcacagtttgcagatattttctcccattctgtaggttgtgtgtttactctgttaatcatttcttttgctgtgtagaagctcttcagtttaattaagtcccatttgtctattttttattttattgcatttgcttttggggtcttcatcataaattctttgcctaggtcaatatctagaaaaggatttcctaggttttcttttaggatttttatagtttgaggtcttgcatttaagtcttcaatccatcttgagttaattttaatatatggtgagaggtaggggtccagtttcattcttctgcatatggttagctagtttccccagcataatttattgaatagagtatcctttcaccattattaatttttgttgactttgttgaagatcagttggttgtaggtgtgtggttttattttgggggtctctattctgtttcattggtctacatgtctattttagtaccagcactatgctgttttggttactatagccttgtagtataacttgaagtcaagtagtgcgacgcctccagctttattctttttacttaagattgccttgccaactcaggctctttttaggttccatatgaattttagaatagtttttttctaattctgtgggaaatgatattggtaatttaataggaatagcattgaatctgtagattgctttgagcagtatggacatttttaatgatattgattaatgagcatagaatgattttgtatctgtttgtgtcatctataatttctttcaacagtgtttcacagttctcttcatagagatatttcacctcctttgttagatgtattcctagagatgtttttgtgtgcgcctattgcaaatgggattacattcttgatttggctctcagcttgaacattattggtgtatagaaatgtgatttttgtacattgattttgtatcctgagacttccctgaagtcatttatcatttctaggaatcctatggtggagtctttaggattttctaggtatagaatcatattgtcagtgaagaaagattatttgacttcctcttttcctatttgaatgcgttttatttctttttcttgcctgatttctctggctaggacttccagtactatgttgaatagaagtagtgagagtggacttgtctggttccagttcttagggaaaaaaaagcttccagcttttgcccattcgatatgatgttggctgtgggtttgtcataaatggctcttatcatttgagctatgttcctttggtgcctagtttgttgagagtttttatcatgaaggaatgttgaattttattgaaggctttttctgtgtctaatgagatgtttatatggtttttgttttcaattctgtttatgtggcaaaccacatttattaatttgtatatgttgaactctccttgcattccaggaataaagcccatttgattgtcgtgaattaacttcttgatgtgctgctgggttcagtttgctagtattttgttgaggatttttgcatctctgttcttcagggatattagcctgtagttttcttttttgttgtgtctttgccagattttagtatcaggatgtactggtttcatagaatgagttagggaagaatccctcctccttgattttttggaatagtttcttcaggtttggtaccagttcttctttgaacatgtggtagaattaggctgtgaatccatacagtccagggctttttattgattggtaggttttttattactgattcaatttcattacttgttggtgtgttcagaatttctttttcttcctggttcaactttgggtgtttgtatgtttccaggaatttatccgtttcctctaaattttctagtttgtgtgcatagagatgttcatagtcatccctgaggatcttttgtatttctgtgggattggttgtgatatcacctttgttgtttctcattgtgcttatttagattgtctctctttttctctttgttaatgtagctaacagtctatgaatcttgctgattctttcaaagaaccagctttttaaatcttgattctttgtatgttttcttggtctcaatttcatttagttctgctctgattttagttatttctttttagtgctagctttgggtttagtttgttcttgcttttctaattccttcaggtgtgaggttaggttgttaatttgcaatctttctatattcttgatgtagtcatttagcgctatacactttcctcttaacactgcttttgccacatccaggggttttggtatgttgtgtctctattttcatttctttcaaaacatttttaaaatttctgccgttagtttttacccccaaataattcgagagcatgttttttagtttccgtatgttcatgtacctttgagagttcctcttggtattgatttctactttcattccactatggtccaagaagatcattggtatgattacaattttaaaaaatttgttgagacttgatttatgaatgagcagctggtcaatattagagtatgttctgtgtgcagatgagaagaatgtatattctgtggttgttgggtagaatattctgtggagtgttctgtctattaggtctgattgttccagtttatatttaagtccaaaatttcttttttagttttctagctcaataatctgtctattgctgctggtggagtgttgaagtccccccactattattgtgtggctgtcaaagtcttttcttaggtctagaagtaattattttataaatctgggtactttaatgttgggtgcatatgtatctaggatagttaagtcttcttgttgaatcgaaccctttattattatgtaatgccgtctttgtccttttttactgttgttggtttagggtctattttatctgatacaagaatagtgatttctgctcttttttgttttccatttgcataatagaaatttctccatctttgagcttatgggtgtcattacatgtgagatagctctcttgaagacagtagaaagatgggtcttattttttaaatccgattttccattctgtgtcttttaagtggagcatataggccatttatgttcaaggttaatatagatatgtgaggtttttttttccctgtcatagtattgttagctagtgctttgtagtcttgattgtgtagttgttttatggaattaatgggctatatgtttgtgtgtgcttttggggtggcaagtatcattctttaatttccatgtttagaactccctaagcatctcttgtagggccagtctggtggtgatgaatttccttagcaattgcttgtctgggaaatactttattttttttgttgttgtttatgaagcttagtttggcaggatatgaaattctatgctggcatgtcttttctctaagaatactaaaaatgagcccccaatctcttctggcttgtaatgtttctgctgagaagtctgctgttagttctgatgggtttccctttataggtaatatgagcctatattatctttttctctagctgcctttaaggtttttttctttcatgttgaccttggacagtctgatgactatctgccttggggatggtcatcttctataatatctcacagaagttctctggatttcttgtatctgcatgctaacctctctagcaaaattggggaaattttcctgaattatatcctcaaatatgttttctaagttgcttactttctcttcttctctctcaggaatgccagtacatcatagatttgatcactttacataatcccatggttattgaaggctttgtttatattttgattatttttaaacaaagttttgcctgactgggtcaattcaaaggaccagtcttcaagctctgaaattctttcttcaccttggtctgttattaatgcttctgtgttttaaaattcctgaaacaacattttcaattccataaggttctgcttggttctttcataatatagctatggtgtcttctaaattttggattatttttctgttttctttgtgttatatttcaactttatctcagcattgagtttctttgccatccatattctgaattctatatctgtcatttcagacatttcattctggttgggacccattgcttgggagctagtgggatcctttggagatgataaaacactccggctgtttttattgtccgagtacttccactgattccttctcatctgagagagcggatgctgctgctgctgctgctgcttctccttctcctcctccttctccttctttttgaatttgctattgtttggatggggctccttgattttttaatctttttttttcctttggttgtatggctgtggtatttgtaatatatatatatgtaatagattggctgcatttctgggtgctttaagggtcctagctctgcacaggtttcttggttgcagataggttcatgcagtggctttctcagatggggcttgttgtagcaatgcaattttctttggttatgtaattcaggctgcagtctagtagatggagcttaagggtaagagccagcaggtaaagatgggagcagaggaaacagagaagcacaaaaaatactcactcccagtgcacattagccttcagtggaggtggagctactagaaaagcctgagaagcagactatttcagctcgtgctccctaggccctgatgggaataggttgctgctgagtctgtgacagtgcaatgaggaaggtggggtgagagaagattcctctccacatctgtttttgggctacagtggtgctgcctccagtgtctggtgctgtgcttgtgtttcttttgacccaagggggtcttgggtgggctgtgctctctcctcccttaggggtagtctgtgctaaggattagatttcctcgggagtggggtccgtctccctcctgctccttgtagctggtagggccctgtcccccaactgaccaagggagcaggctgggggacctagcaatgacacactcagactgcttccagatcacaaagctgtctctgctgcaagtcttgcagcctgggagaaacctagacttcagcaactctcctcccattcctgtcctgcaacaggagaaagtctaattcaatgcctactgctggggcactctccacacttgccacttaattctggctgtgcgggtccttcgccagttccagagcaagcactggaaactctggcccaagactacaatgaatgttgtagccaccactaccgggttgccaaacgacatctctaaactccccaaatggttccaggtgtggatttgtgactggagacggtgggactcctctcgggtgagcagcatgggcaggaagctgtggggagtgcagtccactaaattcttagtctcacagcagcctatagcaaggcattgggtattttcctagatacgtataggggagcctggcttgcctgcccctccttggctgggtggtgaccacatcctcgtcagcctgagttcaggttgaaggtagggtgcagcctgggattaaactctcaaaatggccccagaacctgggactggagagggtggggcaccatccaggcaggaagcatgagcaagaagctgaggggagtgtggtctgcttgcatctcagtctcaacagcagctcacagcagggtggcaagtaccctcgcgggggtgcatggaggtacctgccctctggtctccctccttggagcagtgcagtggctgtagctatgtctgtaaatccctggtatctaggctcaaatcaaaatggcttccagctgaggctgctccaggcttggatgcctgtaggattctgtgtgggttttctttctggagcaacatctctgtgcagtctttaggcagctctgtatgtatgtcaggcacaaggggctagtgggcagagggtttctctcagagctaagatcataaaagcctgtttcggagctctggaatttctcttttactgtttccccatgtccgggagcctctcccggctgtcagtcagttcctggcttggcaagctgcctcagactttttcctaacttacttctggcacttcctatgtcttctctgatgaattcaagcattctctacaaatgatatgtttgaaaggtaagtatctacttgctattttggcttttatccatggagcagacatatgctacctgtgtcccctcctctgaacacttcaaacacagctaaacatccctcatctcaggccttggttctttcctggtgaaagtgaaggcttggggcaattgtgtgtcaataatgagaaatttgggtttgggatttttatcttgctggattcatatgatgaaaataacactattaaaaaaatacttgttgatgcaaagtacttttcctatactatcttatttaaatcatacacttgagtacagagaggtcaagtagcttgaataagattgcagctaatatgtgataaagccaacccagctcctcagacttgggacctgaccctcttccccttctacttgaacatgctgtttgtataggttctcatcaccaggaactttttgtaagaaacccaaatcccacttgctgtaatatgaacctatttatttttgttctatcctcagtgaatataaaaaagaatactcaatcacccccaaattagaggtttattccaaagtggtaggtttacctcatatagtgttaggataataaggccttaagtagaaaacattgaaagagactagcaagttttaaaagaggctttaatcatgtgatcgcatttctcatttccaagcaaagtgtgtgcacatgtgagtgtttgaggctgacgtgatagccctgtgattgtcccttcttccacttctatccaacatgcagaacattttcaacctaaagtataaaactgtagtgaaggatgtaaaagtgtaaatctgggtgctcacaagtatcatcagctcctggaagaaatatcgtatattttctatttctgttctgctcatggatcacccacatgtcaccttttctccaccctgtcctcgatgatgtgtgcttttttgggctgagctctgagaatgaggtgtgtagattaaaattgtactgggactctggcctggcctagaagaaagttcaggagtgagtgtcaatgttgtggttgggactcagtctggttggaggggaaatagttgactaatggaaggaggcaaaggcaaatcctgaaacaggcaggcttgggaagcagggaggcccttaacccagaggcaggagagaaaagtcttgatttaaatgttcgaaaaacggactgaaaataaatcagtctcttttattagtatacggcctaaatttacacttctaatgtcaccaccaaagaataacccatttgttctaaaaggctggcgtctttagttggcttggttatccagtgagggagatgtcttttctgggtagacatccttggtacattgtggataatgctgtaccttccaagtgggtttacatctttttttgaggagctcagatttttatttcaccttaacttggagcaggtagattatttaggacttctgcttctcttcgttttggttttctctttgggaattttgcagctcctggactggaaagggattgggcttggttttgccaggcttctctatggagaaaatatgacatgccttgatgctcatttctctgagcctgaaacatattttacatcataattggctttgagggttttagaaacaggacatgaccagcttttttgaaattagaatgtttgtcaggtcatacctgatgaagaaaatatcagaaatatgaacactaaggtagaaattactttagagtgaatgttggttgatggagtcattcgttgcattaaacagatatttattgaatgcctgatactgggaactgagtaataagaaaaaataaggtgttttctgttttcttaagaggcccacaggagctgagaaggcagccaattacctgtagaaagcatgataagtactatggacgttttgctttgcgttaggaatttcagtacaatgctgcagacaaaggtctctctaaccaatattgtcctctaaacaggagtatttttcatgaacaatctcatatgttagccaaggttatgtttgttcctgtaggttacccatttcacagagtgtagttgttttgatctatgtcaaaaacaacctatgtgccctgtatcccaaaagacattaaaatggcttggcctgttttccccacacaggcttagaagcattacaaatactgtatattgttaagtttgaaatgctaaagagaaaattttcagtatagaatttaatcagccaaacttaatttcttctggaagagctaaatatataagctattgtacagttttagatttctgggaaaaataaaaccttactttttattaattagcatgataattttttcaaaagtgaccagacaattgttttaggatagctcctatttaatatagtttccagagggaatatttgctctgagatgtgagagcttcctgtttcttactggaagcccaaatgagaattcaaagtatgtatgtgtgtggtagtgatggtgggggcacccattactttccaatatatcagtataactccttattcttattcattattattcacttggttcctcttacaatatgaatagaaggagaaaaacatttatagattacttaaaacattttatgagaagaaagggaacaaattagcccatttgaatcactagctttgcagaggagaatgggcagaagatatatttaatctttcatcaaagactttattcgaaattactaatatacagtttcactcagaacagcactaaatgagttattaggacatttaaacaagatcatcattgtttttattagcagcattattccttactccttttgttagaaaaacaccctgcagtgtgtgcaaatctgtttaattgcaatgcttttacattttctttcaaatgtagttgacttattttataaatatttcaagtacataattgctattttgctttaatgaaatcacaaatgtatttagataatctaagaggttagaatacattgctcctatgtcaggtttgtagaagaagtaagaatgacttattgactttattgactatgatcctgagggagagtctttcaccctatgatcctcctttgtagtaaacatctgtggcattgcatacacctgggcttcaagcccagttctttaacttactagttggtgtgatcttaggtaagttctttatcttctttgagcttccagaatgttctgtagattttattgagtatagtaatatgaacttgccagactgataggaggataaatagataataaagtacctaagagagggccaggcaaatagtaagtactcaatcaacgttaatttctttccttgtcagctccttttgattgatagaggagacttgctaaagagattcttgaggttctgatcccagttgtcagtagagatccatcttcttttctttattactgaagttaagaactctagatttaatccaagaccattccttctatgtgctgtgcaaaaaaaagcatgtctttagtcatatgcatcctgtctttgtggttcaacagtggtcacaatagcaaacgtgaagatatcgtgctgatctggaatagagaaaagtggaacagatgtagaatttggggcttggctaaggctgctgggaaatttgcattaggtggcctagctgggaatccagaaaagcaggtgtttttgcaaggatatgacctggggtggtggtggtggtagtggcatggggtggtccaggaggccacagggtacagggcctctgccccccttttactggggcagaggaagctacgtgcatccacaaagaatccattccacagccagtgatcactatttgctcctagaaaatatctaggaaattatccatgttcttatcacttaaccctataactctaagtccacacaatgctcattgacacattgaaatgaaaccagttgcttcagttaatgatgtaatccagtcacttcccatataggcacatctttcttaaagcctcatgctggagaagatgggttggcatgattgtgtggctttcacgtgatactgtcctctggggaggcataggaataacgtcgcctcgaatgtatgaccttgaaaatgtgtgatgtacaatgcattccttggtactgttgcctagagaataacaagaaagtacttaatgtggttgttatttgttccttgctacttccctgggcaaatttccattccaccttagaggtatggtggaaacagaggcagcaaggccaaatcttgactgtccatcagtcgtttctgagatttggagcaaccaaaggctgacctgggcatttctgctcattccaggatgggcttagagattcaccaggccttcctgagaatggaagtcttttctgtacttctcacagagcccagagtggcatctataccacaaaatagttgctcactatggatcaacttattggatgaataaaagtttttctgagataagccctttttatatttgccacttatacttgtggacagttgtgccttgcattgttatcatcatcaatatcattgtaattgtcattaacaggaaacacctgtaaggcaatatccaaggtgttatgcaaaaaagaatgagagacacaatcaaaatagaacttttgagggcaatgaccaagtctttttttgttaacttttattttaagttcaggggtacatgtgcaagatgtgcaggtttgttacataggtaaacgtgtgtcatggggctttgttatttcattactcaggtattaagcttagtattggttagtttttttcctgactgtcaccctccactctccaataggccccagtgtgtgttgttcctgtctatgtgtccatgtattctcatcatttagctcccacttataactgagaacatgtggtatttggttttctgttcttgtgttagtttgctaaagataatagcctccagccccatccatgtccctgcaaaggatgtgatcttgttcttttctgtggctgcatagtattctatggtgtatatataccacattttctttatccagtctatcattgatgggcatttggattgattccatatcttcgctattgtgaatagtgctacaataaacatacacatgcatgtgtctttataatagaacgatttatattcctttgtgtatatacctagtaatggggttgctgggctgaatggtatttctctttaggtgtttgaggaatcaccacactgtcttccacaatggttgaactaatttacactctcaccaacagggtatatgcatccctttttctccacaatctcgccagcatctgttactttttaactttttactaatagccattctgactggtgtgagatagtgtctcactgtggttttgatttgcatttttcttttcttttttttttttttttcagacagagtctcattctgtcgcccaggctggagtgcagtggcacaatcttggctcactaaaacctccgcctcccgggtttaagcagttctctgcctcagcctcctgagtaactgggattacagtcgtgtgctaccatgcctagctaatttttgtagttttagtagagacggggtttcgccatgttgaccaggctggtctcaaactcctgacctcgtgatccacccatctcagcctctcaaagtgctgggattacagacgtgagccaccgcatccagcccttgatttgcatttttctaatgatcagtgatgttgagctttatttatcacatgtatgtcttcttttgagaagtgccagttcatgttctttgccccctttttaatggggttgtttgctttttgcttgtaaatttaagttccttatagatactggataatacaactttgtcagatggatactttgcaaaatttttcatcaattctgtaggttgtctgtttactctgttgatagtttcttttgctgtgcagaagctctttagtataattagattccatttgtcaatttttgcttttgttgcaattgcttttggcatcttcatcatgaaatctgcctgtgcctatgtcctgaatggtatacctaggttgtctttcagagtttttataattttgggttttacactgaagtttttaatccatcttgagttaattttggtatagaccaaatcttaaacgactttttatttctagagcttagcccagtgcttgttgcatagtactggcacagtaagttgttgaatgatgacacctgaaaaagtgaatgtgtatgataagaacagatcaataaaagagctgcaatagctgaagagctatatcttacaccccattttcccttttatttaatcaaaccacctccccagcacttcccaccccacatctgaaataactctctttttctttcatttgagaaaggagtgtatattctatcccagtgctgttacttggatctattaagggaagcacaggctatagtgctgctgtaatgctaggattttggctgccttgaaatttaagagaagaattctttctaatactagaaatagatcaatattgagctcctgctttttctctgtgcccagaacacctactgaaatcaggaggacctggcagtgtgtgggaacagtggaatgggggcctttgtctgttaatttgattttcattctttcatttcactccaaaggtgattctgaaaaataaatgcatttataaggctattaataaccatattttcctcttgatcattatgattaagttgttggtactgccaggtgcctgctgctcccatcacaaagccctgaacaattttgcttcatcatttgactacactgagttactctatgttggaggagttgctgctgattttttccttctcctgtcagttgatttaaattcacactggaaacagagaatcaagtttaaaataatattctaaatcataaaagtcattctttggttaaggaacaataagtcagctttccttttattagactattcccaagaagggtttcatggtcaaaatgtcacagctgggtttttttccacattttttcttcttccatcctgagtgtctcatgatccagttgttcgttgaagcctgcaatccctgaataaatattctcctcattgtatttactgcaaaaatgttccacagatctccatgagttaactccccagaccccaatattccagttcatgctttgcagtgtcatggagcagatcagagtacacaccctgcagaaagatgcccagttttgagccccagctctgcccatctacttgctgtgagattaccagcctcaccaaacctttgtttcttcttatgaaaattagaatcataatagtatctacctcctcagttggtgatgaagagtaaaactttcctggaatactgacagtgctcaatagatggtagttttattattgtgagaatgagaaaagcagttcccaacatccagcagctggacagacagcaagagttcttggtgttctcctgctgaaataaacattttcacaggatatcagcattagacaaggccactctgtgatcgtgaaggataaagaaaaaaaccaagaccattgtgtaattatgtttcaacacagataaattatggacattgtccaagacacaaaactgaccaaacatccctttattctggctaatatgaatgactgctgatttttttaaaccaattatggctttagcctggctctcttcatccctttttccacataagatttatcacgatacttagtcatagaagtacttttgcttcctgatagtatccaatcaacagcaaagtccacttccttaaaccctcccaaaaatcacctaacaggaccaacattctacactaaatcctttctaatactttcttactgagacactccatggttcctcactgtgtgtgttctctcttgccacagcacatgattcaactacacgtgtatttctggtagtctctgtctgcagggcattgacagctactccttttgaaaaccacaagtcacaggatttaaagtcatatagcaaggaaaggacattttgtgaccttggataagttatttaatgtctctgttcattttcccacttgttaaaattaggggactgagctcatgcattctatgtgcctttttagcactaacatgctatgggtatctgtgtcagacacttaccaacattaggagtgctgtggaacagaaatacttaatgcaggaatgtcctcaaattctgatctttcctagactgccaaagaaaatcctgtaattccaaattcaatttatcccctcctcccacctcttcatgaaaaggagctctttctttctgggaaataggctaatatgctgagagtagaggaaggagaagaaggaaagaaaaccacgtaggctgggaatggagaaggagattttctgggaatcacagagactgatagagacatggaaacaccagagagaagtggctgagaggaaacaggaaaataaagcattgtgtagatcatgtatttgtatcccttttattgcctttaaaaagtagcaagtaaataataggattgattattgagtaatctgggttgttgaatagtgtgtcctgaagagaacattcatcaataattgaatgtgagtttataggatttggggaacacatttgttatatagtcagagaaccccccaaagaaggcctgtttctcctggagagcttgccactttatagttaataaaggtaagaagaagcttctttttcaaacattttcaggatttaaccattcacagcttctcctgatctccattcggaaggacccatagagtccagcccttgtgtgggcgataatgagaatgtgcttacatggagctggatgaaagaggcagaaatcagtatcactagtttaaaggtttatgaggcttagttaattaaagcttttaatttgcacgggaacccaaagaagctaatctttgtcagatccaaacagtaagatgactagccattctggttttcccataatgatgaggtttcctgagatggagaacttccagtgctaaaaccaggacattcctaggcgaactgagatcaacttagcattcctcttcctcacagactcaagttttcttccatttaaaatgctgttacagactgaatgcttctttctaacatgttccctgtgcatcagatctctgctaaataatggagtcctagaactggaagggatgcttagatgtcatgaggtcatccactgccttccagtaggtttcattcagctgggctgtttagatcatctgctcctaaaaaacgatgtgctgggaaacagagtccacagatagtgtagagtctgatacttagtctgtaattttataatccttactatttgctatttgaatatctttcatattatgtggtttctttttttcttacacgttattataggattgagaggtgtggctgccagtttctgcagaggaattatggaggttgagtttagaagttcatggttctagcaatagccatggtttggggggaaattactgctttgttttggcaaatgtaaatataagttttcaggaaatatgtgcctaaattaagagtgcagtgtttagacggttcccccaaactgctgttaaaactataaggagattggcttgtctcattgataaggaagaaagttgctaatattttatttcctgcttgttttattaattctttatatttgatattctcttatatcctactcaaatatgtgtatagatctcaataattctaaaagttcagggaatggaattcattttttttggtaaatatattgccgttttctatctcattagggtagacaatttgtctatctcaattggccaaactgctattgggtcgcagtcgccttagcttgtgtaaactataaagaactggttcagatactctatatggaactctgtcaaattctggttcccaaaccttggctcagtttaagacttcaagatacacacataaatgtaaataaataaattaaaagtatatatatatatttattgttgttgttgttattgttagatagattgttttgtcccaaaggtataaccagtacgtggtcactatagtaaatacataaattacagaaaaataataggaagaagaagaaaattactctgattccacctaaagatagtgattgatttgggggtatttctttttgctctttatttctatgtagtgttgtttgtttcacatattataatattgcatcctacccttttcacttataattataacacaagcatttttccatttaatcatgaactctttttaaataacatgtgtaatggttgcacaacattccatggcatgctgtagcatttcagtagaacatagctcggtggaggagacaacagtatacacatagagtaagcttagattatgttctcaaattagttaggcaagaatgtaaaatctgatgggcagcaaggtgtcctcagaggatgggagcagatgcaggataaatcagcatggcttctcttactctgtgctgatcctcatgaggcacgtggctgcagctgatatccttcatagcgggtctctggatctggaaagctccacaatcctttcaccacccttttatatgcttcttggaagaatttacaccaacaaactatgcatttttgttgaagataattattacaacattgaacttttctggaaccaaactcagcaaagaataggtgatgttctcgtcttgaaggacatatagggtatcaatttattgcctcacagctacaaattcactcttcattgcatgctctgagaaaatggatatgggccctttaaatatttttctttgccagatggcaccatgttaatctttgtcggtagagggtgcatgagagacatgataggaggaacgggctttgcttcctggtctgaccatttttatatgcaagctcctggaatgcctgtggtttctccagcacctgggtcctgctggcaaccagcagcacccagtggccagcagcgtactctttcacctcttcttgggtgactttgtggaatgctccaatgtgacatctccctgtgaacgcctttcctgacaccctaaaaagtgtcaggaatttccagcaagttccagagagcaggtttccagcaagtttggtcagtatgacaccacagcgatatctctgccattcactgaacttggattcttccttcttcagtgaggtatggatttcaaccctggattgggaagtggctggggacccttccctgggcactgtatcccagccctggggacagtggctgcttcatattcccgtatccattagcattctcttctttttttttttttcctttccaacttttattttaggttcaggggtacatgcgcaggtttgttacatgggtaaactatatgtgatgggggtttggtgtacagattatttcatcacccagataataagcatagtacttgacaagtagtttttcaatcctcaccctcctctcaccctccaccctcaagtaggcccaggtatttagtttccttctttctgtccatgtgtactcaatgtttagcttccacttataagtgagaacgtgaagtatttattttctgttcttgcattaaattgcttaggatactggcctctagctctattcatgttgctgaaaaggacaagatttcactgttttttatggctgcgtagtattctgtggtatataatatgtaccacatgctcattatccagtccaccattgataggcatctaagtggattccatgtctttgctattgtgaatagtgctgtgatcaacatatgcatgcatgtctttatgggaaaattatttatgttcctttgtgtatatacccagtaatgggattgctggcagttctgtcttaaattctctgagaaatctccagactgctttccacagtggctgaactaatttacgttcccaacagcagtgtgtatgcattccctttgctccacaacctcaccagcatctgttattttttgactttctaataatagccattctgactggtgtgagatggtatctcattgtggttttgatttgcatttctgtaatgattagtgatattgagctttttttcataggcttgttggctgcatgtatgtcttctttggagaaatgtctgttcacgtcatttgcccattttttaatggggttgtttgttttttgcttgttaatttatttaagttccttatagattctggatagtagacctttggtgtatggtttgcaaatattttctcccattctgtaggttgtctgtttactctgttgataattcccttttttgtgcagaagctctttagtttaattagatcccacttgtcaatatttgtttttgttgcaattgcttttgaagtctttgtcatgaaatttttgccagggcctatgtccagagggtacttgctaggttttcttctagggttttcatagttttaggttttacatttaagtatgtaatccatcttaatttgtgtatatggtgtaaggaaggggtccagtttccattttctacatatggccagccagttatcctagcaccatttataaaatagggcatcctttccccattgcttgttttcattgactttgttgattatcagttgtaggtttctggctttatttcggagttctctaacctgttccattggtctatgtgtctgtttttgtatcagtatcatactgttttggttactgtggccttgtagtaaaatttgaagttaggtagtgtgatacctccagctttatactttttccttaggatttctttggctatttgggcacttttctggttccatatgaattttagaatagtttttctaattctgtaaaaaatgtcattggtagcttgataggaatggcattgaacatataaatttctttggacagtatggctgttttaacaatattgattcttcctatccatgagcatggaatatttttccatttctttgtgtcatctctgatttctttcagcagtattttgtaattcttgttgtagggatcttttacctccctgtttagctctattgctaggtacttctttgtgttgcttttgtgaatggggttgcattttaaaaaataatttaaaaaattttgaggggtacatattaggtgtacatatttatgaggtacatgagatgttttggtacaggcatgtaacacataataatcatgtcatacaaaattggctatttatcccctcaagtatttatcctttgtattactcttttagttattttaaaataactaaaattatgcttttagttattttaaaatgtacaattaaattattgttgactatagtgcccctgttatgctgtcaaatactaggtcttactctttctttctattttattttgtacccattaaccaaccccacttcttccctgccctcccactacccttcccagcctctggtaactatcctgttctctatctctgtgagttcaattgttttgatttttagatttcacaaataagtgagaacatgtgatgtttttctttatctgcctagcttatttcacttaacatgatgacagccagttccatccatgtcgtcgcaagtaacagaatctcattcttttttttgtggctgaatagtactccattgtgtataagtatgacattttctttatccattcttctattgatgaacacttaggttgcttctaatgttggctgttgttaacagtgatacaacaaacatggtagtgcagatatctcttcagtatactgatttttttcttttggtacatacccagaagtgggattgctggatcacataatagctctattttagtctttcaaggaacctccaaactgttttccatagcggttgtactaatttacatttccaccaacagtatatgagggttcccttttctccatatcctcaccagcatttgtttttggctgacttttggataaaagccattttaactggagtgagatgatatcttgtaattttgatttgcatttctctgatgatcagtagcattgaccactttttcatatgcctgtttgccatttgcatgtcttcttttgagaaatgtctattaaaatattttgcccatttttaaatcggattattagatttttttcctatagggttgtttgagctctttatatagtctgcttattaatcccttgacagatgggtgttgcaaatattttctcccattctgtgggttgtctcttcactttgttgattgtttcctttgctgtgcagaagctttttaacttgatgtgatcccatttgtccatttttttctttggttgcctgtgcttgtggggtacgactcaagaaatttttgcccagaccaatgttctggagagtttcctcaatattttcttgtagcaatttcataatttgaggtcttagattgaagtctttattttattttattattaaactttaagttttagggtacatgtgcacaatgtgcaggtttgttacatatgtatgcatgtgccatgttggtgtgctgcacccattaactcgtcatttaacgttaggtatatctcctaatgctatccctcccccctcccccgaccccacaacaggccctggtgtgtgatgttccccttcctgtgtccgtgtgttctcattgttcaattcccacctatgagtgagaacatgcagtgtttggttttttgtccttgcgatagtttcctgagaatgatggtttccagcttcatccatgtccctacaaaggacatgaactcatcagtttttatggctgcatagtattccatggtgtatatgtgccacattttcttaatctagtctatcattttggacatttgggttggttccaagtccgctattgtgaatagtgccgcaataaacatacatgtgcatgtgtctttatagcagcatgatttataatcctttgggtatatacccagtaatgggatggctgggtcaaatggtatttctagttctagatccctgaggaattgccacattgacttccacaatggttgaactagtttacagtcccaccaacagtgtaaaagtgttcctatttctccacatcctctccagtacctgttgttccctgactttttaatgattgccattctaactggtgtgagatggtatctcattgtggtttttatttgcatttctctgatgaccagtgatgatgggcattttttcatgtgtcttttggctgcataaatgtcttcttttgagaagtgtctgttcatatcctttgcccactttttgatggggttgtttgtttttttcttgtaagtttgtttgagttctttgtagattctggatattagccctttgtcagatgagtagaatgcaaaaattttctcccattctgtaggttgcctgttcactctgagggtagtttcttttgctgtgcagaagctctttagtttaattagatcccatttatcaattttggcttttgttgccattgcttttggtgttttagtcatgaagtccttgcccatgcctatgtcctgaatggtattgcctaggttttcttctagggtttttatggttttagatctaacatttaagtctttaatccatcttgaattaatttttgtatacggtgtaaggaagggatccagtttcagctttctacatatggctagccagttttcccagcaccatttattaaatagggaatctttcccccatttcttgtttttgtcagctttgtcaaagatcagatagttgtagatatgtggcattatttctgagggctctgttctgttgcattggtctatatctctgttttggtaccagtaccatgctgttttggttactgtagccttgtagtatagtttgaagtcaggtagtgtgatgcctccagctgtgttcttttggcttaggattcacttggcaatgcaggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatactcttttacttcactgagcactggtttgtagttctccttgaagaggtccttcacatcccttgtaagttggattcctaggtattttattctctttgaagaaattgtgaatgggaattcactcatgatttggctctctgtttgtctgttattggtgtataagaatggttgtgatttttgtacattgattttgtatcctgagactttgctgaagttgcttatcaccttaaggagattttgggctgagacgatggggttttctagatatacaatcatgtcatctgcaaacagggacaatttgacttcctcttttcctaactgaataccctttatttccttctcctgcctgattgccctggccagaacttccaacactatgttgaatgggagtggtgaaagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaattttgtcaaaggccttttctgcatctattgagacaatcatgtggtttttgtctttggttctgtttatatgctggattacatttattgatgtgcatatgttgaaccagccttgcatcccagggatgaagcccacttgatcatggtggataagctttttgatttgctgctggatttggtttgccagtattttattgaggatttttgcatcgatgttcatcaaggatattggtctaaaattctctttttttgttgtgtctctgccaggctttgatatcaggatgatgctggcctcataaaatgagttagggatgattccctctctttctattgattggaatagtttcagaaagaatggtaccagctcctccttgtacctccggtagaattcggctgtgaatccatctggtcctggactttttttggttggtaagctatgaattattgcctcaatttcagagcctgttattggtctatcagagattcagcttcttcctggtttagtcttgggagggtgtatgtgtcaaggaatttatccatttcttcttgattttctagtttatttgtgtagaggtgtttatagtattctctgatggtagtttgtatttctgtgggatcggtggtgatatcccctttatcattttttattgcgtctatttgatgcttctctcttttcttctttattagtcttgctagcggtctatgaattttgtcaatcttttcataaaaccagctcctggattcattgattttttgaagggttttttgtgtctctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttaatgctataaatttccctctacacactgctttgaatgtgtcccaaagattctggtatgttgtgtctttgttgtcgttggtttcaaagaacatctttatttctgccttcatttcgttatgtacccagtagtcattcaggagcaagttgttcagtttccatgtagttgagtggttttgagtgagtttcttaatcctgagttctagtttgattgcactgtggtctgagagacagtttattataatttctgttgttttacatttgctgaggagtactttacttccaactatatggtcaattttggaataggtgtggtgtggtgctgaaaagaatgtatattctgttgatttggggtggagaattctgtagatgtctattaggccgcttggtgcagagctgagttcagttcctggatatccttgttaactttctgtctcgttgatctgtctaatgttgacagtggggtgttaaagtctcccattattattgtgtgggagtctaagtctctttgtaggtctctgaggacttgttttatgaatctgggtgctcctgtattgggtgcatatatatttaggatagttagctcttcttgttgcattgatccctttaccgttatgtaacggccttgtctcttttgatctttgttggtttaaagtctgttttatcagagactaggattgcaacccctgccttttttttgttttccttttgcttggtagatcttcctccatccttttattttgagcctatgtgtgtctctgcatgtgagatgggtttcctgaatatagcacactaatgggtcttgactcttcatccaatgtgccagtctgtgtcttttaattagagcatttagcccatttacagttaaggttaatattgttatgtgtgaatttgatcctgtcattatgatgttagctggttattttgctcattagttgatgcagtttcttcctagcctcgatggtctttacaatttggcatgtttttacagtggctggtaccggttgttcctttccatgtttagtgcttccttcaggagctcttttagggcaggcctggtggtgacaaaatctctcagcatttgcttttctgtaaagtatttcatttctccttcacttatgaagcttagtttggctggatatgaaattctgggttgaaaattcttttctttaagaatgttgaatattggcccccactctcttctggcttgtagagtttctgccgagagatccactgttagtctgatgggcttccctttgtgggtaacctggcgtttctctctggctgcccttagcattttttccttcatttcaactttggtgaatctgacaattatgtgtcttggagttgctcttctcgaggagtatctttttggcattctctgtatttcctcaatttgaatgttggcctgccttgctagattggggaagttctcctggataatatcctgcagaatgttttccaacttgtttccattctccctgtcagtttcaggtacaccaatcagacgtagagttggtcttttcccatagtcccatatttcttggaggctttgttcgtttctttttattcttttttctctaaacttctcttctcacttcatttcattcatttgatctttcatcactgataccctttcttccagttgatcaaatcggctactgaggcttgtacattcgtcacgtagttctcatgccatggttttcagctccatcagatcctttaaggacttctctgcattggttattctagttagccattcgtctaatcttttttcaaggtttttaacttctttgccatgggttctaacttcctcctttagctcggagtagtttgatcgcgtgaagccttcttctctcaactcgtcaaagtcattctctgtccagctttgttccattgctggtgaggagctgcatttgtttggaggaggagaggcgctctgctttttagaatttccagtttttctgctctgttttttcccatctttgtggttttagctaccttttgtctttgatgatggtgacatacagatggggttttggtgtggatgtcctttcactttgttagttttccttctaacagtcaggaccctcagctgcaggtctgttggagtttgctggaggtccactccagaccctgtttgcctgggtatcagcagcggaggctgcagaacagtggatgttggtgaacagcaaatgttgctgcctgatcattcctctggaagttttgtctcagaggagtacctggccgtgtgaggtgtcagtctgcccctactggggggtgcctcccagttaggctactcgggggtcagggacccacttgaggaggcagtctgtccgttctcagatctcaagctgtgtgctgggagagccactactctcttcaaagctgtcagacagggacatttaagtctgcagaggtttctgctgccttttgtttggctatgcccttcccccagaggtggagtctacagaggcaggcaggcctccttgagctgcagtgggctccacccagtttgagcttcccagccgctttgtttacctactgaagcctcggcaatggtgggcacccctcccccagcctcgctgctgccttgcagtttgatctcagactgctgtgctagcaatgagcgaggctctgtcggcataggatcctccgagccaggcatgggatacaatctcctggtgtgccgtttgctaaggcccttggaaaagtgcagtattagggtgggagtgacccgattttccaggtgccatctgtcaccccttgtcttggctaggaaagggaattccctgaccccttgtgcttcccaggtgaggccatgcctcgctctgctttggctcacgctcggtgtgctgcacccactgtcctacacccactgtctgacaatccccagtgagatgaaccgggtacctcagttggaaatgcagaaatcattcatcttatgcgtcactcacactgggagctgtagactggagctgctcctattcggccatcttggctcagatttaagtctttaatccatttttatttgatttttgtataaggcgagaaatagggatcaagtttcattcttctgcgtatggatatctagttttcctggcatcatttatcaaagagactgtcttttcccccaatatgtgttcctggcacctttgttgaaactgagttcattgtaggtgtgtggatttgtttgtgggttctgtattggtctatgtgtctgtctttatgccagtaccacactgttttggttactatagctctagctctgtagtataatttaaagtcaggtaatgtgattcctccagctttgttttttgtttgtttgtttgtttgtttttttgtttgttcagaatagctttggctattctgggtcttttgtgattccatataaattttatgattttttttctacttctgtgaagatttcattggtattttgatagggattgcattgaatctgtaggttgctcaaggtagtatggacattttagcaaaattgttttttccaatccatgaacatggaatatctttgcatttttctgtgtccatttcttccatcattgttttataattttcattgtagaggtctttcatttctttggttaattcctaggtatttggaattgcatttgtgatttggatctcagcttgaatgttattggtatagagaaacgctactgatttttgtacattgtttttgtatcttgaagttttactgaagttgtttaccagatataggaccttttgggcagagactatggggttttctgggtataaaataatatcatctgtgaagagagatagtttgacttcctctattcctacttggatgccttttaattctttctcttgcctgattgctcagctaggacttccagtatgcatttaatatgagtggtgagagtgggcttccttgtcttgttctggttcttaaggggaatgcattcagcttttgcccattcagtatgatgttggctgtgggtttgtcatagatggctcttatattttatgcataatttgttgagggtttttaacatgaagagatgttgaattttattgaaagccttttctttgtctattgagatgatgatgtggtttttatttttccttctgtttatgttatgaatcacatttattgatttgtgtatgttgaatcaaccttgcatcctaggaataaagcctactttctcatgatggattagctttttgatgtgctgctggattcggtttgatagtatttagttgaggatttttgcatctgtgttcatcaaagatattggcctgatgttttgtgtctgtgtgtgtctgctgggttttggtatcagaatggtgctggcctcatagagtgagttagggaggagtccttttcctcaatttttgggaatagtttcagtagaattggtactggctcttcattatacatctggtagaattctgctgtgtagccatatggctcagggctttttctgattggtaggttttttatgaatgattcaattttggaactcattattggtctgttcaaggttttaatttcttcctggttcaatcttgggaggttgtatgttttcagtaatttattcatttcttctaggtttctggtatgtgtgtgtagaggtgttcataatagtctctgaggagtttttctatttctgtggggtcagtgctaattccccctttgtcctttctgattgtccttttttgaatcttctctctttttttctatataattctaactagtagtctatcaatcttatttattatttcaaaaaaccaactttaggttttgttgatcttttgcatgttttttcacatctcaattttattcagtttggctctgattttggttatttgttttcttctgttagctttggggttttttttttcttgtttttctgattcctctaggtgtgacgttagattgttaatttgagagctttctaactttctgatgtgggcatttagcactataaactatcctcttaacacttcttcatttgtgtcccagagattctagtatattgtatctttgttttcataagtttcaaataatttttttatttctgccttaatttcactgtttacccaaaagtcatttatgagacagttgtttagttttcatataattgtattgttttgagagatcttattagtattgatttctgtttttattttgctgtcttccaaaggcttggttggtatgattttgatttttctgaatgtgttatgaattgttttatggccaagcatgtggttgattttagagtatgtgccatgtgcagatgagaagaatgtatattttgttgttgttggatggagtgttttgtagatgtctgttaggtctatttggtcatattgtgtttaggaatatgtaacaaatatgtaacaaatatctttgttagttttctaccttgatgttctgtctattactgtcagtggggtactgtattagtctgttctcacactgctataaagaactacctgagactggataatttatggagaaaagaggttaaattgactcacagtttgcaggctgtacaggaagcatgactgggagggctcaggaatcttataatcatggcaaaggcaaaggggaagcaagcacatcttaccatggcagagcaggagagagagaaggggaaagtgctacacactttcaaacaaccaggtatcttgataactcactcactatcatgagaatagcaagggggaagtccacccctcatgatacaatcacctcccaccaggcccctccttcaacactattaattacaatttgatatgagatttgggtgaggacacagtgtcaaaccatatcattccacccctggcccctcccaaatcccatttccttctcatatttcaaagcacaattatgctttcccaacagtcctgcaaagtcataactaattccagcattaactcaaaagtccaagtccaaagtctcatctgagacaaggcaagtcccttctgcctctgagcctttaaaatcaaaagcaagttagttactttcaagatataatgggggtacaggaatttggtaaatagaccttttctaagagggagaaatcagccaaaacaagggggctacaggccccatacaagtctgaaacccagcagggcagtcattaaatctcaaagctttaaaataatctcctttgactctatgtctcacatccaggccacattgatgcaaggggtagactcccaaggccatggacagttctgcccctgtggctctgcagttcccacagctgttttcatgggctggcattgagtgcctgcagcttttctgggcatgtggtgccagctgttggtgggcctactatcctgaggtctggaggatggtggccatcttctcacagctccattaggcagagccccagtggtgactctgtgtgggagcttcaaccccacgttttccgtctgcactgccctagttgaggttctccatgagggctctacaccacagcagacttctgcctggacatccaggcatttccatacatcctctaaaatctaggtagagactccaaaacctcaactcttagcttctgcacacctgcaggctccgcaccacatggaagccatcaaggctttgagctttcaccctctgaagcaatggcccgagctgtacattggcccattttagccatggctgaagctggagtggctcagatgcagggcgccatgttctgaggctgcacagagcagcaaggccctgggcctggcccatgaaacatttttttcctcctaggtcttcaggcctgtgataagaggggctgccatgaaggtctctgaaatgccctggagacattttctccgtcgtcttggcagttaacattcagctcctctttacatatgcaaatttctgcagccttgaattcctcttcagaaaatgggtttttctttttatattgcatggttgggctgcaaattttccaaacttttttttttttttttttttttggagacagagtctcactctgttgcccaggatggagggcagtggtgtgatcttggctcactgtaatttccacctcctatattcaagtgattctcatgcttcagcctcctgagtagctgggattacaggcatgcactaacacacctggctaatttttgtatttttagtagagatggagttttgccatgttggccaggctggactcgaactcctggcctcaagtgatctgctggccttagcctcccaaagtgctgggattacaggcataagtcaccacacccagcccgaattttccaaacttttatgcttgcttcccttttaaatataagctctagttttaggtcatttctttgtttatgcaaataagcataggcttttagaagcagccaggtcatatctggaacactttcctgcttagaaatttcttccgtcagaagaaatttcgtctctctcaagtccaaagttccacagatctctagggcaggggcacaatgccactagtctttttgctaaagcatagcaagagtgaaaaataattattccagtttctagtaaattcctcatctccatcagagaccacctcaggctggacttcactgtccatatcactatcagcatttaggtcacaactattcagcaagtctctagaaagttccaaactttccctcatcttcctgtcttctgagccctccaaactattccaacctctgcccattacccagttccaaagtcacttccacattttcaggtctctttatagcaatgccccacttctctggtaccaatggtggaatggctttttgaagtcacaatcacaacgccaactaggtgtgaaaatactttacaaggtttgggcaaagttctccagaaggctgtgtatgctttgaatcagcatccaatatatggtactgtttttcccatagcgggattcatgggttcaggaatcaaggggtggaagtggaagtggcagcattcaccatcacccctagtgacccactagcaaaatttttacattcttttcccacaacattatcttctactggcctagaggtcttagttccagaggaaggaatgctgccaccaggagacacagcaatgattccatttaaccggaagttaagattgccacctggccactctggcctcctcttgcctctaagtcaacaggctaagaagggagttacagtgttggctgaagtgattgacccagactatcaagatgaaataagactactactccacaatggaagtaaggaaaagtatgtctggaatacaggagaccccttagggcgtctcttagtattaccatgccctgtgattaaggtcaatggaaactacaacaacccaattcaggcaggactacaactggccagaacccctcaggaatgaaagttttggtcactctaccaggtaaaaaaccgtgaccagccaaggtgcttgctgaaggcaaagggaatacagaatgggtagtagaagaaggtagttatgaataccagctatgaccacatgaccaggtacagaaatgaggattgtaattgtcatgactatttcctccttattttgttataaatatgtttgtgcatacatacacctgtactgagaaagtgtcttcattttatttcccttctttttcctttatcacgtaacgtaagatttattgacttcatatcagcatttaagtgttgttaactttatttaatagcatttaggttaaggattagtgtgcttcttgttgtatgaaggatagttgtattatgttaggcataattatgacctattattttctttatttggagattaagtgtgatttcaggagatgtgtatgagtgccaagttgacaaggagttgacttgtgatagtcaatatgaggtgacaacctgattggattgaagaatgcctagatagctggtaaagtattgtttctgggtgtgtaagttaggatgttgcctgaggagattgacatttgagtcagtggactggaagaggaagacccaccctgaatgttcaatgggcaccatccaattggcgccagtgcagctagaacaaaagcaggaggaagaaggtgggataagacggcttgctgtgtcttctggctttcatttctttcctgtggtggatacttccttttgtttctcctgcccttggccatcagactccaagttcttcagccttttgactcttggacttctgccagtgtttgacgaggggctcttgggccttcaaccacagactgaaggctgcactgttgactttcttgcttttgaggcttttggactcagactgagccactactggcctctatcttcctcaacttgcatatggcctattgtgggactttgccttgtgatagtgtgagccaattctccctaataaacttcctttcatatatacgtatatcctgttagttctgtccctctggagaaccctgactaatacaggtactgatgtcttccgctattattttgtggttgtctaagtatcttcctaggtctcttaaaatttgttttatgaatctgggttctccagtattgggtgcagatatacttaggatagttaagtcttttcgaattgaacccttaatcattatgtaatacctttctttgtcctttttgtcatttgtcagtttaaagactattttgtctgaaattagaatggcaacccctgctcttttttgttttccatttgcttgcttgattttctttttccagtcctttactttgagcctaaggatatcattgtatgtgagttggatctcttgaaggcagcatacagttgggtcttacccctttagattcttaattcttcaccttttaaatggggtgtttagaccatttatgttcaagtttaatattgatatgtacagatttgattctatcattgtggtgttagttggttgttatgcagacttgattgtatagttgctttatggtgtcaattgtctatgtactgaagtgtgtttttgtgatggctagtaacagttttttgtttccatatttagcatgcccttaaggacctcttgtaaggcaggtctggtggtaatgcattcccttagcatttgcttgtctgaaaaggattttttttttttttcatttatgaagcttagcttcactgggtatgaaattcttggttggaatttttttcttttgagaatactaaatataagcacccagtctcttctggcttgtaggatttctgctgaaagacccactgttagcctgatagggtcccctatgtaggtgacctatccgttctctctaactgcctttaatattttttcttttactttgaccttgggaatctgatgactatgagtcttggggatggtcatcttatatagtatctcacagaagttctctgaatttcctgaatttgaatgtttacctctctagtaatgttgggggagttttcatggacaatatcctcaaatatgtcttccaagttgcttgttctccctccctctttttcagggataccagtgagtcataggtttagtctctttacataatatcatatttctcagaggtttgtttattttttttctttattttgtctgactaaattttttttaagaaccagtcttcgagctctgagattctttcctcagcttggtctattccgctgttaatacttttgatttattatgaaattattgaaatgagtatttcagatctatcagatcagtttggttctttcttaaaatgtctattttgtcttttagatctcttatcattttattggactccttggattgggttttggctttctcctgaatcttgatgctcttctttgctatcctgattctgaattccttgtctgtcattttagtcatttcagtatggttaaaaacaattgctggggagcaagtgaagtcatatggaagtaagaagacactttggctttttgagtcgccagagttcttgcactggttctttcttatctatatgggctgatgttcctttaatctttgaagttactgccctttggatgggttttttttgctttctttgatgcccttgtggtataaattggattcagttaactggcttcattgctgaaagatttcagggggctacagctcagctcagcacagctgggctgtgtgctgtaatcctaggcagctggtagcaggcccatggctttattctctggtacttcaaggttaagcacctcctgcactggaggggctgaggtgttcccggcctgctggcaacaacgatctgatgggggatgctggcaaaactgcttctttggggtatggcagcagggtccttgcatgtatgtgtgcactggtgggagcagggcagcagagtccgtgcacacacatgcttgtgccagtagcagcaaggcagtggagtgcgcatgcacatgcacgggcagggcctgtctcacagggttcttgtgagggttaagggagataatacatataaattatttgaaaccgtacctggaacataataagtattcaataaatattatctgttgttataagttaatctgagtggatctgagattgaatttggttggagggccacaaagacaaatgtagtgcctgacaggagcatatgccacagtttacttagccattcctgcgtggcagacattttgttgtttttgatgttttactgtaataaacaatgctattattaacatatttgtgtgcaaaacccatgtacttgggaactttatttatagtggggaatggcaagtcatttatctttaaggaggtgcttcataaaccaacataggttttggcctcacccaatacagcaagtagaattattataaagtatagaataaatcttgttgaggatcttagtgactcaaagtttgccaacttgtcaagaacctctttctaactgcttcttaacatgtgacaaagcaaagtttttcttttgagaaaataataatattcaatacacagtaagtaatcttatcatagtttttaggatgtcctttggctctaagttaggcacattgaaaatgcccattctgagttagttagttaattaagttaatacttattcaaatgtcaaatggtttagaaattaaacaattttgggatgggacttcaggaatgacttaatagttatatgaccttgggccagttattttaacctctgtgaattaagcaattattttggcctctctcagactcagtttcctcataagtataataaaaataataatgcttatgttaatttttatgcaacaattatatattgagtttctattacatgacaggtacttttctaggtgcttgggatgcatcagtgaaaaaaatctccctgttccaaaggaccttacattctagtggtagcaaggacagatgataaatgataaacataatgcttaaataaattatatagcatattagaaaatggtaaatgcaatggaaaatggaaaacacagtgttggataagaaggatcaggtatgcatggaaggatcaatatttttaaaagtgcagttagggtaggtctcactggggtaatatttgaacaaaaatttgaaagaggtaaggcagtcagccatgcagctatgtggggagaggtattccaggtagagagaagcaagtggaaggcccttaggtgggagcatgacaggcatattttaggaatagtaaggacagtgtggctgaagcagagtgaatgagggggaagatggttggagacaaagtcagtgaggtaacaagtcccagatcatgttggaccttctaggcattgtcagagcttcagattttgctctgggtgaaatggaaagtcatggaggattctgaacagaggaacagttgaacttatgttttatcagaatcattctgactcttgagtgaggataaactctgggggtgcagctgatattgtcactccttctccttcctgttccccttcccatggaggatacagcctggcagctgaaaatgtgaggcagcgaaggggttggggcagccatgcagaggcataggctggggttggggagctgcaggctgtgggtcagaagctgagggggtggtgtggaggtggtaggtggaagacacagccagcatggcgggtggtagagtggggagagggagttggtcacactgagcaaattagtaaattgatggtgaatgtaagaataatgggagccaagtttttcactgctggagaaggaatttataaacagaaatgaggaaggctagaaggaactctgaagttggacaggaattggaggtatcagtatgaacatatgattgtctgtctagctagctttgtaattatagatgtttaagtgtgtgccatatatatacacatcatgtccaagctctgttcaccgggagggcttagtagcaataacaccttagtaacaattagtacaatgagcacccagacattggtttctaaaaaccatctttcactggaagataccaaggctccttggagtgatggccaatggctgattccaggttggttggggtgggagtggggagacttggaaagtgtaagatgagcctgcaacgtcttgtactggacaataaggaaaggctcagtgaatggtgggaacatttcaaaaggacacaggggctcctattggtcaaatcagggagaatttttgcattaaagaataataatggattacaactcattgaataaaataggaatctgtgaatccattccgatgcgaatgaataaatgaatgaaaagggtaagcttgactttactataaaatgccaactaataaatgtataaacaataatgtttggcaactttcacagatgtagtttgatttgggctaaagtcatcgatgaagtctcacagaggatggatgctaaggctgaaaggtgaaggtttcatgaggaacaggatattctgacatattctgagaataccttcccctaacatataaatcaattacaaagaaaaaatggtaaatttaagtggagaaagctggcagacatcaacatgaccaggagaccaaggtgggataggttgacattgtatcacttctgatgtgatgccctgagaagagaatgtcattgtttctgtggaattcttgccctggatgaagtgcctgagtctgatcgtaaggaaccatcatcctacagggggtgatcctaccgaatgtaacacttcctactgtgccaagtgcatggaagatggggaaagactgagacacttccagatcaaaggattctgaagagatataacagctaactgtgatgtgttcgtgaaaaactcctgaaccacagagggaaaagagacattttagggaaattagcaacagctgaatgggatttgatggtagtgtatcgatgttaatttcctgattcaaagagttgtatgctgattatataggacagtgttgttgcttttggaaaatccacactgaagagtacttttggggtgacagagcttaccctcaaaagcttctgattatgtagttaaaattatttttaaatacttttatttctaaaagaaggctattggaagtgagagataatgatgatttagatcagggaggtgatgtggcagtggtgggaaatggtcagactcaggatatattttgaagatagaaccaatagaacttcctgatgaattggatataggttatgaaagaaaaataggggcaagaatgattccaaggttttggcctgagcatctggaatgataagtaaactgtgggtgagacaggtttttggagggaatatcaagagtaccatattggatgagttgagtctgagacactctattagacatcctcctaattaagatgtcagggaggcagttagagacaagaattggaagttcaggaagggatttgtgctggagatagaaatttgggagttatcagaaagcagatggtatttaaagtcatgaggggatgagatcaccagaagaggaaatgtagagaagagggcattctcaggactgcttggcaggggtattttcagcctaggtaaactcactgaaaaattactgaaaaatgtccaactatgtaaaaatccacggctaaagtcttcaaagaggtaacagtttgacatatgcaaagaggattaacaacataaagaacaagattattataaacattaacatttacattgtgtttactatgtgtcaggcacaatgttgctttatatagattatcacatttaatcttcatctcaatcttgtgagaggggtaatatcatttctagttttcatgtgaggaaactgaagctcaaagaatttaaataatgtgttaaaggtctcacagctagtaaatagtgagcctgggattcatatccttgtgatctgcctacactaccttccattctaatggctgcactatcctgcctcaagtactggacgaggacagaaagaagcctgtcatggggctctagacccctcttgactgcccaaaacaaccacatcaaaccaacattttcacacacaccacaccacacacacacacacacgtgcacacacaatcaagagctgaagccttagaagatataagaacattccatctttcaggctgactgcccctcacttacggccatgtcagctccctgagagaggtcttagaaattttagtgtgttggaggaaggacttacagtggagtaaacccatgtttccaaggaccatggtccaacaataggcagtggaaagagtatcccaggctccaaagagcaacatcagcgtctgggttatgaacacgaccaaccctgtgtttttaagagctccatctttcctgaaatatccttcttttggcttgctgttatttgccacttttataagctactgagccacatcactggtgtgaacagtttcaaagcttacatatttcttcttgtaatcagtttagtcgatcttgtaactataaagagtgagatggtaaatcctgagctctcattctgagtcagaatttatgataagaacaacgtgcttgtgcccaaacagaaccatgcatgtatggtaatatggcacttgaaatttatgtacttccttttatccaaggaacagaaagtgcttctgtaaaatggatttagagccaactgtctacagcaggcaatgggaacagttcaaaaaaggactgccgagagaatcatttaatttatgcaaggccagggttcacactaaacaaccatgtgccccaatttgtttcacagaaatggttccaggagaccactgccatttcaacccctgctcaacagggatgaattcaactgcatctttgcccaccagttgtatatgaagacattctttcatccctgcggtttagtgctggttgctgcacaggactagcccctggtattagctgaggagatcaccagcagaatgggtcccatcattcctttccactgactaactggttggctcttcttcttagtaagggagagcctttatgattaactgtgctagcatgaaaaaactctagtcttgtaggtaagcccactataatttataaccccactataaaatattatggcttctctctatcacacacttcaaaatgcacatgctacagtaggtccttgtattagttacctatcgctgcataacaaattatccaaaacttagtgcgttaaaaggtttattatgtcccagtgtctgtgggtcaggaatcctgacatggcttgactgagtcttctgcttcaaggcctctctcaagatcttacccagggctgtagtcatctccaggctagactaggggaggacttgcttccaatcatgaggtatttggcatgattcaattctttgagggctgtgagactaaggccccagtttctcacaggctgttggttggaggtctccttcagtcccaagagagagcaccagcacgaatgaagtcacagtcttttgtaacctaatcacagaagtgacatctcatcacctttgccatattctatttgtagaagcacgtcaccagttcacatttacgggcaggggcttacccagggcatgaaaaccagaaggcaggaatcattgggagccactttagaagctgcctgccaccatccgatgtatattgtcacacttgtccttataatgatcctccaatgcagcgttagtcctctcatttcacagatggggcaagttctcagactttagtacttgcacctactgacacatttatctttagtgactcatcgtgttcattcatgtatgcatttattccacgactatgatgtgaaagtacaaaatattaggtatgctactgtgctaggtgccagtaagttttattcttggtaaactataggtgtatacagcatcctagtagttcttcaatgagtatttactgagaggaagaactgttcattatatatgtatatatatatatgtatatagtagtgcctaatttattgtgttataccaatagtagatggtagtagtaattagtatttatattattaaatataaaaattatattttatgtattataagaatataataattctcatgagttgttaatctatttttataattttaaaatatataactgggagtactcttctggtttttgagggtctaggattcaataacttctgtttcagagatgaataaatatagatgaatagtggttatgatatagacgatgccccagaaactgaaatggagaatttcattccagtcctatttgtagcccaaactctatgtacaaactacatgggaaaagctgacatgtaacttgagtcagctccacgttaaacacacattgagtacctgccataggcattagcaaggctcatcattgtattgctggtgagatcatgtacaaaaataattttgcaaattgaaaaatacacataaatataaaagaattttttaaattgtttgtgctgcttccttaactcagggaagcctacaaggtgccaagttctgtggtaagtgcttcttaaaatgttacttaatccttctcacaactgctctgaaaagcaaggtcagagctcctggttgctggtggttcaaaaagggttcatttctgtctgctgagagggctctgcgatctgtgagttcgtggtggccaaacatagggagacttccaagtgaaaccctcgttgatgacatagtgaaactgtgagtttattgaagtgggaatacaccccctcctaacttaccccacacagaaacagatctgtgcaaacatgcttgtcctttttaggatgatacaataacttttgagataatggaagatactctggaatcttggaagtcagtgagaggaactactggcatagtagttcttgactaacagaaaggcaggagttctcacagactagggttagctgagagacagtgatttggccatctccaacctatgcaattactcaggggccaaaggaaagacaagcccagtttaataaaacccaacagcagggatgtagagaatcaataaatgttggttgatgtccacagggcagcttggaagcaactggaagaccttttacagctggttatttttgaacaacaatctaagatgtataaaagcagaaataaaaataactgaagaaaggagccctgacttgctgccttgaaatcatgagtgtgctgtggttgatttgtagctttttgcagtatggtcaagatgacccctgattcaatacctccttttcctaccacctgcctcccctgggtgggggaggggaaaaccgtgctaaaatattctatagaaccagtactctaagaagcagcctctatagcaaccaagcaggtaggaggtagctgctgtagtttctatcttttacctttttcctccaaatatccagatttctaaggggtgagaaaacacaaacaccaaaaacatcattggaattttggattaaagacaagacagctatctgtcttgtctcatttttgatacaccagctgataattgggctatatctgagtctaaaaataacacatagtacattaaaataatattccttggctacaattccaaagtggtattctgggatttctgtgcattaatcctgtaacaataacaggatttgggcttttaactcccctggtgtagctttgaaaatctagcctaaagcagctaatgttgccgtttaaatcatcctctcactatccttagggaaatgtggagattaaaaaaatgacagcccaactgctcaaatgacctatacctgggagaataagagaaacaacctatttcctctcaggaactgggccgatcaatataaatatttcaaaaggaccatcatgcaataaaggccttggaatttgtatcctacatcagagcaccctagatatttccaacatagacctatcaggttttccacaagggagggagacattgtaacagttgaataactggaactgaactgggttgcacgtgtgtgagcctctgtgtgtgtgtgtgtgtgtgtttgtgtgtttaggaaaggaagggaaaggaggccattattattgtgtatgtttctggtaaacattctttttttcccctactgaaacttgggcgtatcccagaaattaggtgctgttaatcgtgtcagctaaaaaaaaaaaaaaaaaaaaaaaaaaagcatgttctaaaatatgcacacagttctaaattgaagctctaaatagctttaaattgaagtggcaggagtttttcaatgataccattaattgcatttcattaattgggaaaaagagcttttgtgtagctgtggttatgatgggctggatttaatcagtgtaggtaccactaacaggctggcactgctttcggcctgcaatgcctttgaaattctaaaatggaaaaggaggccaacacactgagcaattatttcagaacagattgcccgttaacatttcataatatcaccgaaatacatcctttctgggacagagacttgctttggctatgaacatccaagaggtggcagcaccccatgctccgttggctttctgcatccctccagatgagagctcaccgcagaggtctcatcattgcgtcacctgaaagccagttaggagggcggaggtgggggggaggtgatggagggaagaggtagcgttttgtatttcagttcttctggaagagttcaggaaacagctgcatggattgttttaaatggacttgaaaaggtttttcttttcttttcctccctgaaatctactgccctgtgcagtatctctctatgaagaccacatgagtgcacttacgtgttctctgattcactccctgagggaggaaggaagagtttcaattgcctgggatcccctgagacctcattttcaattctctgcacttgtcttttataaacacaggaaggtgggatgaagacggcattattgacaattattttttgagcatgtatgtgggcagggcactgaccacatcatcaagaatgtgacacagtcggctgctaggataattctcttcttccctaactgttcctccaggtcccccatacacatagaaatctcatgctaaaaatattttacacaacaaatagctgttgagatcgcatcaaaccctgaacaataaggagcaatataaccttacgtgctaggtgtcatgtgcctgatatgagaagcatctggtgacatgggtgaaggagtgtcagggctggtctagcctggccactgtccaactatctgtggaaactggccctcgtcatgctaggaagtgtgagggcaagagctggaatacactgaggcagccttgctgttgggggttattggcagctgttgggggttagagacaggactctcatgggtaagtagtgtgcaaaatgccacaggaggctggagctgggctcagcaacagtctagggtccagcacagctcagctgtgggcctatccccatcctatccagcacagggacttggcctctgtgtacaccactacggctgcttggcctcaccttcaactctgtgtaccttttccttaactcatttcttcagcttagtcttgaccttgacaccctcataccctctgtcccatagctttcctacatggcacctgctctctgggtacatctttttagcttctggtcccactaacaattcagagactattttccctgtatttcctggttaattttgagggaagtgtggagggggaagggaaggaggaagggaagagagactcattggctgagttaattgcattcttcctgtctggacagagctttggaggccaggccatctcccaggggatgagttaggctctgcttggccacctttgagtcacttttagacctgtgcagggctgtcccccagcctgggctatgggcatggttgttcccttcaggaggaccgtggatgtggtagacaccaaatttgacatattgtccctttccccatacaaaggaaggctcaacgatgctggatatcctgctgtcagggtactaccctggtgagttgctcagactctaggaagagagaaaggaacctcttttcttctttacaagaaagcagtcatgaagcttggagaatacacataagagtgataatttacactcaatcttcaatgattccagaaacttggggaaagaggtacagatccttcatttgaaccatgatgccatgtattttgcatagcgcagcttggtttggactaggctgagggaggggagtggctgagttagataccagtctccttgttatagtcaagtcttccttaataaggtctcaagcttgcattttaatccaaagacagattctcgagtgctacctcttggtgctacttctaggcgccatgacatattcagcaatgagctcctcacctgttgcccagtgcattggcagcatccctggttgatgcagccaagccatctggagcagggcaaggggggcacacggggtatgaaagccagatagctgccagatgctgcagtttcttggctgtggccttggccttcctctagtcctttcactattatgctgagggcatgtggcaaaacaaggcaggccccacgggcagcttatttgcttttggctacttccagttgagccaccaagaacttgaggagctttttcttcttcagctatttttcttgagagcctgaacatcccctccatctcttccacttgtagcgcttgtagtcagcctcagccataagccactgacaagagtgtattaactgcagatgtgaggatgaagcaagggcaaactatggttagttttcagaggtgactgagccccttcaacatatagatagggatttccatatatggtgaattttgtcactaagtgcttggctttgtggcatcctatttaccagtatttgaagcttttatttaacagttttattatgtggttctctctggtgttgagtttgagctcactaattagatcattaagttccttgaaagaaagacagggcttctatactcctaagcatttcctgcaatgtgtaacacagcactgtcattgtacaaggaattggcactcaatgggtgtttgttaaattgatttgacccaatctcaatttcatgttcagctcaggagatttcttattaagttctaaggagtttagatcctttctggtcatctatacctgaaggtataaattcattttgaccaattttccaactttaattttctcttgtgcacttcaggaagaacagcaccccagacatgactttttcagggacttggaattccagatttcccctgggattcaaggcatctgggagtttgacttcctattttttacttttcatctctgtcctcttgaagttaagcatggtgatgtgacttactttggctaatgaaatatcagatgtaatgtgtgttagcctcctctgccaaattaatctcctttcctagaaggataggtgaagttatgcagtggtaacaacagcttccaaaacttagtcgagattctgtttgacagagtgactcagggacccaattgacagacagtctgtcatctcagtgtgtgctgccgggatcactgtggcaggggaagctggcatggataatcgttcaccaactcttagctaactcttccaccctgaagtgacacacattacaacagatagttcattcaagaggatggagaagtgcagtcctttcctggctctggaaagaaccaagagccaaaaatacttgtgacctctgtagaactgaccacacctcctcagagagcccagaagttgctgtgtttcagttcattctttaataaggcatgggacgacccttgggaataatataaatactttatcctttgaggttcacaggagttaagaaacaaacccgtattaaagatgatttatgtattaataattaaagattagatttttaaatattatgtaaatatcaggttattttccaccaaatcagtgatcagcagtactcagttgtagcactctctaaatgccatagaaacagatggctgatggaagtgattggacgtgtttagagttgccagcccttttcatgcttctgatgcttcttacacctcacagtcactcaaaggcccagcagctcagagcccttctccatcatcagagtcacttcagactcctgggctctggggatctgatctttattccctgccctgtgattgactctgtcagtcacaaagcaagactccaggttcttcaaaagcaaacagggagtcatcctgcctcacttagtggtcctgtgttccacactcactcgataacttccctccttccaaagatacaattctaggccaggctcagtggttcatgactgtaatcccagccagggcaggggaggcacttgaggtcaggaatttgagaccagcctggcccacgtggtgatacccgtctctactaaaaatataaaaattagccaggcatggtggtgcacgtctgtggtcccagctacttgggaggctgaggtgcgagaatcgcttgaacccaggaggtggtgtttgcagtgagccaagatcgtgccactgggcgacagagtaagactctctcaaaaacaaacaaacacaaaaccaaaaacaaagatacaattctaaccataagaaccaggagtttattcacaagtgtaatgagtttagtagtcaatgctcttttagcccaagtcaatggactattattccaacatgccaagtaagagccaaccatgatatgattgaaagagcttttgcattagaatctaaagactggttcaactcccggctctgccatgttctagctgtgttacctaggaaaaatcacttggcctctctaaaccttcactggtaaaattaggataattacacttaccttctaggatggagtttcctactgataaaatgtaaattataatgcctacctcttgggatcatgggaatttaaattattttgacaaagataatttatgggaaaaatatatatgtataagtatgtatatcccaagctgggaacttcttccctccttttttgcttgctaattaagagtcataaataaaatgctgatgagctgcagtctgccgtctgtgctgtagctggagggctgttttgacttagcctgacaaatggctaaccagccgctcccactatgcccaactcaagtgttcagcactgagaaatccagctactgccaacagcatcttataaacttgtcactatttacttacttggtgacagtgtttttgttcagtgatcatccctgagattttactcgtcagggtgtgtctgtttctctcaaaatgccaaaatgccaaaatgccatttaaatataatcctttctcaaaccacatgaaaatagtgaaggtctctaaatgagactttgatgcccttatagttcatccccattgcagtgcagttggggtgggatgttgtctttacaaagcagtagctgcatgtgcacagggctttattaaatggacacaaacttcagagctacttcaataagctactagtcaggatttccaggtaacctgttgagtggtgtgctagagacagctcatacaagcttggaagaactgattgttacattttcaggaattttgcaaggtggttgaaatcatgttggtagactgaaattggccatggtgagagtgtttacaccatggaaattagcaaacactacaaaatcaggcagtttctcccagagggctggttgctaaacatttaccagctcaccaatctttgagcacctgggtaaaacacagatgtgactgagaatgggagaaggggcatcccaaatcggaagtataaataaaaccatgatgcaggactcacttctctcgagtccctgctgtgtgctaagttctatgctagcctagattgagactgacatatatcaggaggtacctagcaaattagcgatgtggggcctaccaaaaatgtattcatatgaaggacagagagcctgctaggagcttgactgcaagctggtcatgggagagagggaataatgctagatgtaacatggtacttgtcactcaggtttcaagccaggccctagctgagatttgtagagggtgggttggggaaagctttaagtaaaaacagaaaaggctgctttgggaacactctgtaggacaagatggcattgtttggatttgacatcttgtttgttccaggacctcagctgcagtagttttgggacagcagaggcttggctgacccacacagtgcagtggggtgggctcccttgcaagctcttttgcaagagcactttgtggaggaccacagtgtgaacaaagagggggaaagggacagtagaatttattttgatgaccccatatgtactggtaaggcaaaggggaagctggttgcatatacattttctcaacttatcctcacaacacccttatgaaaaaggcattatcatatcctctttgtaggtgaagaaactgaggcttggagggtccgaataacttgcccaatatcacagaaagtaagtagcagagctgggattcacacatgaggctgactgcaaacccttcttggggcctctgtgaccaccctgaattcatgtctgcatattcatttattttcttctaatttggggggaagaagtctctctcttctttccaaggtcaacctttccactcctgcccataaatcctgtaccttcctaattcctgctccagagtctttgtaaagcaccgcattgctctgttgtgcatctttagcctttcttctgtcagtttattcattaatctttgccatcttttaacagaaatgagtgactgtgtggggactttcttagccttctctcttagcctctgtgttgtactgaacacagaacacattctcctttattcttgaaactctctacttcccatcttctgtgattggtttttctcttccctctcaggtttttcttctgatcacttctggctcttctccctttcccaacccatgaaatagaagcattactccaagagtctagtgttggctctcttcttcttgtggtccccatgacctcagcactctatgcagacaaatatatgaatatatctacagctctagttaggaaatgggcagaagtaactcaaccatgtccccaggaccaagagcagtctctggcatgtagtgggtactcagtaaatagtagggatttcagatgaagagaacattgtgaacagaggctgtgcatgtatgtattgatttatttggaggatacccctttcaggctgctgaactcctcaaactcaggaactgtgctttttcctcatttttaatttcctgatccagcataatacatagtagctgttcaatacatgtttgctgaatgaatgagtgagtccaaggtcgatgataaattgatgcaaaactgtggcagtccttatataggaatttaggctttactgtatgtgcagtaggcttgcagccatgcaaggctttttctcatttgagtaactcaattgaagctgagctccaggatgactcatgtggctgccgtcagcattgaaaccttgtgccgtcttcctcccttgcccttgctgttccatctctaatcagtagcccaatcttgttgattttacttccacgtgtggctttatggcttgtatttgtgtttttgtttctattctcatggccacctcccaaggtcagctctaattacctcttgtctggatgtcagcataggtcactccccactctggttgctgttgatcccttttctgtaagccacggccttggctatgctactgatgactggctctgtttgaaaaaaagaaaacagaacaaagcagaattggttctgggaaagcaaggataaagagggctaaagtaacactccattatctgcctttaatcccacaggcccttaaagctgttgcctgctttgggttttacccttgagttgcttgagtgggcttatcccctcattgctccttataacaaagagtaggatccattctcacaataaagttaaattgtagggaaagaaagcggaccaatgggaagcttgtgcttgactatgttgttgaaaagaggcaaaggaaatggaagaacaatcctttagagaagggagaacaagagaagggaaaatgtaaaagaggagataggagaaggccattaagataataattctagagggaaggaagaaaaaaaggagagaagaccagagctgagctcctgccatttttcatagctaattatgattaaatgggccgtttctgaaaatgctcaataaatgtgcactattaccttaaggttttgctctattgctatgcaatgcatgggcattgcatgaactttatcagtccagaattttacctaataaaacagtgagctaatggactttagggggcctctctggggactcttgagcttaagcgatttaggtcagtgttatgcaaagtgtgatttgcctcctgcaaggaggtaagtacagaaatccacagtctgtatttagaaactttatagcattgcacattgctacaatgatgtgcaggaggtgggtggtaccagtcaagagagccagagccagagagatcgtgggcatttcttcccatttttgcagctcagtaacttcactgtggtagcttgaaatcagccataatgggaggtatttttatcatgcaaattgacaaatgctacaaatcaggactcctcccacccttaagaaccgggtactaaacatttgcggcacgccactgcttggctgagaagtccaagcatctgatgaggaaatactatggaacggcatgttgttccactttcttggtgagttacttgtgactggagctgcctacccagacgtgcatggtaggatcacctatctgtcactaaaggaatagaggaaattggtccttcaccatagggagtttgaaatgcactgccctagatcaccttcagcttgttctgagatccaacagagtatttcaacagaggtcttcatgataaccaaatgtaatagcccactggtttagaaacctcctactccagattttgagtcctataagacagttaggatcaagggtagctgtggcagacccagctggggcagagaagccaaatgtgaaatagcagaaggtatgtgtattagtctgttaggactgccatgaaaaataccaaagaattggtggcataaacaacagaaattttttttttttcacagctctggaggctgtaagtccaagatcaaggtgttggcagacttagtttctcttgaggccactcttcttgccctgcagatggccgccttcttgctgtgtcctcacatggtcttttctctatttgcatgcaaatagagaaaccctggtgtctcttcctcttcttacaaggacaccaatcctataggattagggccccacctttattacctcatttaactacaatgatcccttaaaggctctatcttgaaatacagtcaccttgggggttgggactttatacaaaatttgggaggacacaacccagtctgtgtcagtgtgtcactgtgctttacctgtcggggctcactctgcattccaatcaagcatggtatagtgggtcacaagactggagccaaggaggcttgacctgactcccaggtctaccttcccattggctgtgtggctttgggcaccctaatctttcttatcctgcattattcatctgtaagatgaatataatacaagagcttccctcacagtgtagttatgaagatcaagtgaagtcatggaggtaagcttttagcacagtgtctggcccatgataggtgcttaataaatgtatacttttaatttatggttttgctctattgctgtgcatttcatatacagtatatttttaggtctcagaggaggcctaggtgtggagagctgatgcaaagagtcttgtatctcatttttagatccccagtctatcgtcctcatctccaatatcatgggtaagaaaaggccaaggtttttctgacaccccctgttttacacattcactctgaacttgctaaggccgactttgagtggagagccatgatttcctgaagatcaataatgccaaagaatccaaaggcatcacttgttaaccaatttcccagtggcctggcctgcagtggggtgagaggcatcagaaaacacacaggaactgagaatcaatgcactgggaagaaaaccagctccctcaaaggggctaattttcccagtgtgtaaataaattatgtaaacaaatatctgatcatatttataacctctacttctgaaagatccacctaggtgaatttatttgacttttacccactagaagaagtttgtttaaacaatattatcaagaaaaatcatgtagtcaaattgttagactttaaagtcaaaatgggcaattttatacatgaggaaactgatatgttttaaaaaaaatctcctggtgtattaatttgaagacgacaagcttttaattaaaaacacaaaaataagattcttagatgaaaaataaagtatattatacctggttcaatattcttttggataattcaaattttggtgatcagaaaaaagatgcataggcttttgctgcataagatcttgccaagatgcttttactgcctggcattgattttccctctcacccactccaggcattctcacttctgttggatgccccttccactttctagcaatctccaacctcatcaagggctatccctcctccagttccccctggagtcccatctctgttcttgtcttccctgactactcctgcttgaaaagaaatcttcctcacctgaatcactctagcacttttactctgtattgttaatttgccaattaatcacatccacctttgcaatgcctttcatgatatgaccttgaattgcatggttttagggcttgtctatctttttaagctgcaggtaccctgagaaagggacctcatcttactctttgacactcctcccccgtttagtgataattagctgtgtgccttttatagagtaggaagtcaatgaatatcacagagttatctgctttttcctgaaatggttaagatcattttatgttaataagtgtgtgtctagtcaaacttacagcagtaagcactgaggctttttcttttttaattgtagatatcaagctggaattctctagtaaatgctcctggaatgtaatctgggggtgccattgttccagtgagttacagtaatttttaaatctaactctggtgtaaaagagacctgggttgagttctagttttcttggttaccagctgtctgaccttgggtaaattactacctctctgtgatggttaattttaggtgtcagctaggttaagggattcccagacagttggtaaagcattatttctgggagagattgacatttgagtcagtggactgagaaaggaagatctgctctcacccagtgtgggtgggctccgtcaaatcagctgagggcctggagagaaccaaaaggcagggaaaaggcgaatttgctctctcttctggagcttctcctgccttgtacatgaggacttcagggtctctggccttcagactctgggacgtttgaaccagcagcccccaggttctcaggcctttggcctctgaccaagagttacatcattgtcttcactgattctgaggccttggaacttggactgagctataccactgactcctctgttctccagcttgcagactacctgtcatggggcttctcagcctccataatcacatgagccagtttccgtaataaccctgctcttgtctgtctgtctatctatctatctatctatctatctatctatctatccatccatccattctattggttctgtttctctggagaactttgactaatatactctctaaagcccagtatcttcctctgttaagtgtgagtaataataacaccttatctcataaggtggtggcagaggagtaaaatagaaatagtagcactcaatgaatattagatttttatcattaatattattgtgacatacagaggtcaaaaagtagaaaccttacccatggctatcagtctccattcgtctgaaccaagggtaaagagtaagaccggtggccgggtgcgattgctcatgcctgtaatcccagaactttgggaggccgaggcgggcagatcacgaggtcaagagattgagatcatcctggccagcatggtgaaaccccgtctctactaaaaatacaaaaaaaaaaaaaaaaaatagctgggcatggtagtgtgtgcctgtagttccagctactctagagggtgaggcagtagaattgcttgaacctgggaggtggaggttgcagtgagctgggatcgtgccactgcactctagcctggcgacagggcgagactctgtctcaaaaaaaaaaaagtaagactggcacaccagtggcgaattggccatgcaggagctgggtctttacttccctgtgcccagtgctgctggataaggaatataatatttcctgtgcagaattcagaaggagcactttcctatctaggaagaggtgacttgtgaaccacctttggcctcatgttgtcatcacctccccaattcccacttccctttgtaaagcataaaacattttaatacctacaagacactatattttgtgttgttactctggagttgggcaggttgcactgccagtacaatcatattcattaaagataagtcagcaggacatttggcctggaatgaatgatgaaaccaagtcaaaccatattcaatgttttctcagagatgttcaagaaaaagaacaacttcagtggaagaagaagaagataggagccca

SEQ ID NO: 257 - DNA, 77 bp, Homo sapiens
accatgtaacccaggctggcctcaaactcctgggctcaagcaatccgcccatctcagcctcccaaagtgctgggatt

SEQ ID NO: 258 - DNA, 574875 bp, Homo sapiens
ttttcctgcctcagcctcctgagtagctggaactacaggcgccgcgccaccactcccggctaatttttttattttattttattttttatttttagtagagacggggtttcaccgtagccagaatggtcttgatctcctgacctcgtcatccgcccgcctcggcctcccaaagtgctgggcttacaggcgtgagacactgcgcccggcccatactactacttttttgtaagtattctttcaaaatatttattttcatatgcatttttcgtttacctaaatgacatcatgtaaactattccatcttggcccttaattttttttctccaaacacttaaattttcaaataatcttagtgaaaaattagcagctcaatcgctttaatttttattactttcactgttaataaaactgaataagttttcataaagttaataaccgtttatattttcttttgtgaggtggctatttatatattctgtacatttttctcttttctctattgtttcatatattttttctttttcttattgatttttaaaggttctgtatgaggtaaatatattaacctctagccaaaaaacgggtatttgtcttattaacttaattaaaataattaaattattttgttctattttaaaactatgtagaatttctttaaatgtaatcggtttatgatttcttgagtttttaaaaaatataatgacatttcacccaaactaattagcaatattttcttctagtattttgtagttttcgtttttcaatttattctgatgtgaaatctaaagatagggcttttgtttcccccagaataatgacctaggtgtccaacaccacatattgaatagatccattctttgtccagtgattttagcagtaatttttatcatatgttaacttagatataaaacagggtctgttcaatcagaacttccaggtgtggtcaaacagcatgcaaaatgcagtaagacacctaaaaaaggtccagtgcagaataaaatccagccaagctcttttgccagccaagccaatggagcttgcgagcaagaagaaagggatatcttttctaactacaaaggcatcttcggctcctagccaagcacctgcagagcttccttggaaagaattgggcatcatgtgggctagcggtagtcctttcccatttaatagtcagtgtatttctgcaatagaacattattaattatctcaaactatcattgtttaaaatatctactggggcaaattctcctttattattttctccccctttcaaaggtttcatcactattctctcaaagttatttttccaaatgaactttggatccattctgttaagtttccttgtcacaacttcctatttcctacctttgcccacaaaagtcttctgttagaagtgtgttcaactcatgtatcaatttacttgaattcacttcattattcaattttttcttctgatcctgaaaaaggatgctttttcaacttgaaaagacctgactctgcacccattcaaattatatttttactctccaatctattaaattaccacttgttaagttccatgttgttgctaagagtgaaagggccatttttctacaacaattgcaggacataaataatacttggaatagaagagccctacttaacacgagtaatgagagaaagcacagatcttaatcaagggtcacatttctgcttcttgttccagttcatgtgcactctagatgatagtgaatgaataccttatatggagtccagccatgaccaaaagacaggagctaacactcagcttcatggaaaggcccaatctaatgtccaggaatagactcctgaggtatggtcttctgccacagagctttcaggcctagaaaatttgcttgaagcagttttacttgcttgaaaaactgctgcgataagaagatatttttttcatttgaagtctcacatacttaaaatacaaaaatagaacaaagacattgcattgcaaatagaattacagtcttattttcttaatagagtaaaaaataaattgtctaaaatgatttttgacaaaggaaactttttatttgaaaattatgatttgcagtctttcactagaatgctaatttattaactctcttcaaaatcctgtatcagaatttactcaggcttgctgatagggcttaacaaaaaagcaaagctaagcaaggcacctatacgcttgggcctgacataatgtgatttgagaaaatgtcatcatgctttaaaatgcaaagcgcctatcacaaccgaacaacaaaagacgttctctcattgagtatcttttccataacagggctaaaataattctgagagtggcttttctgtaaaaggcagtctgtggcaagaattgttggaacagagacttgccatgctggttctgcatcaacagtctctctagctcagcaatctgagaatacacacggataaagtgctatcagttcaatggaaattggcaggttttcagagggtgtgactgcagaagactattgttcaatttcaaaaatgaaaccctccagaagcaatttcaaagttatacaaatctttcacgtatactgagagtgcaggtgaagatcatccattttccacataaaaataaattgttaaggacttttaaatgaacacccctacctaaaatgcagtgttctgtttggaaatctgtacattatacaagtgaagagcataataaatcttgaaaaaaattaaatttttttcattgaaatatttttgtagagtgccatgagtttgggggagaactagtgaaatgtacatcaacaattttatagatttataagacagttcttaaagtgtcaagaaagctgtcatggcttaaattttatttaccgaattaagcttcagatatttcttataaaagtgaacttcaggctgttgagttttgaagggtgaagcataggataaagctttaaagcatgtgctttggagtccaaagtcacggttaaaatgtattctctactacttactgactgtgaaatcttggacaagtcactttcttctctgtattagttcattctcacattgctataaagaactacctgacactgggtaatttatgaagaaaagaggtttaattgactcagagttccacagactgtacaggaggcatggctgggagacctcgggaaacttacaatcatggtggagggagaaggggaagcgagcatgtcttcccatggcagagcaatatacagagagcaaaaggggaagtgttattcacttttaaacaaccagatttcatgataactcactcactatcacatgaatagcaaggggaaaatctgcccccatgatccaatcacctcccactgggtcccttccccaacattgggaattacaattcaacatgagatttgggtgggaacacagagccaaaccgtatcactctactttaatattagttttcttatttttgaaacagttgtcaagattaattgagttaataaatgtaaagcacttagcataatctggcaagtaagtataaaataaataatggcttttcatggaaacaggtaaaactatcaaaacttttgatatgttagtgaaagtttttcatgaaactgaatcaatatgggtcaaaataaaaggaaaacaatagctttggctgaaattaatctatagatgtacatttttcttggaaaaaataaaaatatttttggtgttatttttgtctagaaagaataatgattatttctatgattatttttattttttaaccaatctacagaattcattcagatatccccagattttctttttatttttcaacctttattttagatttgggggtacatgtacaggttttggtatgttgagtgtattacctgggtgtattgtgtgatgatgaggtttggggtacaaatgatctcatcacccaggtactgaacatagtacacaacagttagtccttcagcccttgtctccctcaccttcctagtagtcctcagtgtctattgctgccatctttatgtccatgagtacccaatgtttaccttccacttataagtgagaacatgctgtattcaattttctgttcctgcgttaatttgcttaggataatggctttcagctgcacccatgttgctgcaaaggacataatttcattcttttttgtctgtatagtatttagtggtgtatatgtaccacattttatcaaatccactactaatgtgcaattaagttgattccatgtctttgctattgcgaatagtgctacaataaacatacgagtttgtgtgtctttttggtaaaattaattgttttcttttggatatataccaagtaaagggagtgctggatcaagtggtagttctaagtcctttaagaaagcttcaaactgctttccacagtagctggactaatttacattcccctcaacaatgtataaacattactttttctttctagccttgccaacctctgtctttttttaccttttaatctagccattctgactggtatgagatggtatctcattgttcttttgatttggatttctctgatgattagtgatgtgaagcagctcttcatgtttgttggctgtttgtatgtcttcttttgagaagtgtctgttcatgtcttttgctcatttttagtgaaattttttggttgttgcttaattgtttaagttctttacagattctggacattagatgtttgttggattcatagtttgagcatattttctcccatcctttaggttgtctgtttcccctgctgatagtttcttttcctgtgcagaaactctttagttaattaggtcccacttgtcaatttttgtttttgttacaattgcttttgaggacttactcataaattttctcaaggccaatgtccaaaatagtgtttcctagattttcttctcaaagatatctccagtttttctatcaatgccctttttctattccagaattccacatagcatttatgtctcttagtctcttctaatctgtgacagttccttgatcttttcttgtctttcatgactttgacacttttgaaaggtgatggtttagtatcttgtagaaagtcccacaaatcaaggttgtctgctgttttctcatggttaaactggggttatgagttttgggggaaattttcacaaaagtaaagtatcctcattgcatcatattggggtacgtgacattgacatgagttcacacgaataatggtaagtcagtatagatggtgtctgccaggtttcttcactgtaaagttactattttcccttggtaattaatcaatatttggggagagatactttgagacaatacaagtatgctgtttctcttaaacttttacccactagttgtaacatgtattggtagcatgtaacatgtaatattggcacatggtaacactagttgtaacatgtacactagtacatgtagttggtacatggtaacattatatataaaattatttatacataatttagaattattttgtaaggaagaaggatttcttttccttctctttttacagtcatcttttagcttagttcaaatcttaaaataatgtctgctcaatgaactagactaaatgtacatctagggagcaagaatgatggagatcagacctgccccagaagttccatcaccattcattcagtattcagtattgtgtttctaatgtcagtcactgagctagtgtaggagagatgatgatgagtaagtacagcctctacccttaaggagctcacagtccagtagagggaaacacaatgtaataaataaaattataaataaatgtggttaggcactaaaacagatatatatttcttcattgtgggcaagatatagtaacaatttaaaaagcagtcatgttgtcaaaatgagagctgaattttgaaaagtgattgtgtgtatagcaggtagacaagaaagggagaaacatttatggcagaggaaatgacattatcaaagcctgagaaacctgaaatagcaagagaatatgaagaagttgaaatagcttagtgtgttggggagcattggatcagggtctcaaactttatagggactgggagctactgcaagtcttatggacaattttgttttagaaaaagcactctggtgaccatttaagagaagatattgaagttatgtgagattggaggtaagaaacgccaatgaagagagttagagtctcttattatcaaacttattatcaggtgtctgatctgctaaatacaagagggtgtagaaatgacaaactttagagtgatgtgatttttatattgtattaagagaacataccagggagagggtcttacagctttgatttttcaaaatgaattttcagctctggtcataacccattaacatgtttgagtaccttaaattccgtattattaggattttcagtactgctgactacttagaacagttagtgtcatgattatagaaaaatctagatttgttggagactgcttttgtctagctatcttcacagtcttacaatgtacattttcataatctttactagtttgctggaaattaaagaagtctaggtatctcaagggacctatcttatctataatcctaaagttatatttattcaggaagtaccacccttttaattactctaagtcaatatttaatcctagctgttaggaaactttaacgtcatgggagtgaggtcagttgttgaagaaattccagaaaagtggaaagataaataatagaagaacattccagttataagtgaacaatttggagtctaaataatgcaatagtatgaccttcagtaaaggagcacaatcaaatgacaatcagatagtaagagaacagggaaaacgtgctgacatcattcacttcttacattcccatttccatctggggctacccattggccaaaaccaatagaaaatctgaaggcaatgaaacagttggatgcagtttctatgggtcagtcttttatagaacagagcaggataaagaaagatggaaagtatatctaaagatattcagtgcattttaactaatattttgtaaggctccagacttatctttatttagattgcatttttttaatatacatctctaatgatagaggggttttaatcaatataaatgtttggaatttactacatttaaggaagcccaggacttattaacattttgaatatgttttatcacttttaaataaattttacagttattggaaacagaaagaatatacaaagatacagaaatcacacacatacttgaaagtagttgtatatgtcattttatgtaatggaagaatgatatgaaataaaaaatgattatagtttacaggcttaaaaacttcagtttcctactgggcatcgtgaaatccaatttgacattaaaacaaataggaaaacccacaatagatatttagaaaaatcatttacataatgctcagacatcaaaaacttcttagatgcctttaggcaaagcataatatgtttttatgatactaacattcaaatgtcttcttcaagtgaagtatatgatgtaggaatccggtttttgtgtgtgtctgttagtacaatgcttgaattttcacatggataattgaacagtattgtcatcatctacttcaaataatgtttaagagtagtagagattacaatattaataagttgagtattaccacttattatttttactactatgaaaaaaatttctttttatagtaaatctttaaactgagacaatatttaaatacacacttaaatacaaaagtcaaagtaaatgactttttacaaatttgagattctttttcagaatattctatttgtatcagtttaaaaaattagtttcggttagccagacccttgtcaaaagtaccttagaaatatgatttttttttctggtaagcattattagtttcatttttatagaaaggaggtaatttttgcagactatacaccactaacaaaaggcagaggagagttttaacctatttatttatttagtttgtttactgaaagtcttcaggctacaattatattgagatgttttctatagctttcaatttcaatattggttttcagcaatatgaaaatattattctgtttacaaaaatgattacattttaaattgatataatagtttctgtcataaagatgagtactaagcctcttacataagtggtcttgtcaagtctaaaacaaagagttagagatcatgtttgagagaagtaatgtagtgacatagaacacaacaatcaccgaacaaacaaaaaaaaatgcctgggctgaaggcagaacaatggggtctgggttttggttatgccccaccagagctctgtgagtcagttgtagtagcccaggataacattttatggtattaaataagatattgttttacatgcttccttgtacccattgttctggtaacaacatttccttcacatacaggtgcaggcattctggcttttgagctcctaattaggctttcagaagcccaaactgcaaacaatagcttgaaagttacagtgcttttgatttccaaatgataggctttattgagagaaaaaacgtttcgtttggaatttctaaaactgagtttggcatactgaaagcaaggctggcagaactaatgccaagaatcagaatagagaagagtgataatctaaaacaattttcttaccccaaataaacaaataaaaaagggtctagctgtgggattctaggaacagcagaagtagctgccttggctctgtggatagtcaggaagctctatacctttcaccttactggagagttaggagtaacagtagctgagagagcaccccactcacagaagaaggaatgctccgtcctcccagtggaatggaaacaaaatctctctataaatattacacctccctgctgggagtgttggctcagcctgtaatcccctcacttttggaggtcgagtgggcagatcgcttgagcccaggagttggagaccccccctgggccacactgcgagactctgtctctacaaaaaacacaaaaatcgggaggtggaggcagaagaattgcttgagccctgaaggcggaggttgcagtgaccagagatagcctcactgcactccagcccgggcgacagaaagagaccccgtcctaacaaacaaaatcaaaaacttacattgcacctcccaaaggctgaggactacagtgctgctttccccattcccaatcctcttcctatctgaagaaggggtaggaactagttcttttatttttgcgggtggctctctttagaaaataccagtatagctcctctttatttctcgttttgggttttcagcacaacaagacagccagaaaaatctcattaaaaattccgttatgcaaattcttaaagattatctagaaataattatatttttagattatacagtaataataacaatggtttttctaaggtttcagtgatgggttgagaaataaaaagcattatagttttgtttattgagattttaacaatgatgaagtgagtttcaaaggagaaaacacatttgacaattttctgtcacagggattcatctgtgtacaaaatttatacaatataaaaagctcatgaaatctgccatgtggaatataagacgtagatgtcataagtgagaaataattctcatacagctacacatctcgtttacgtttgcttcagaatacagatacataattaacttttttatataatggaaaattggactggttgttatgacagagcatgactccacttggaacttatacagggtatgtttaaggacacacagcatgtattgacacacaaaaaaatctgaaaactctgttctataaatacggttgttctgttagacatcgttttcacagagcctcattgaaacagtttatatgagtagcagtggaaaatagtcaagagacattaaattagaggcggcctatcacactgtattaggagctttatgttttaaaatattccaattttgatttgaaaattaatcagaattctacttgaatctcaaattccaaagtctcaggaaaacaaaaaagaaaaatattattgaaggcaagaaagtgatgtctcaactataaacataagttataattgtaattttaactattaatttcaaaaatttcaatgaaccgttaattattttagacccacaggtaaattatggatacatctctctctttttttttaactttcaagaaagttacgatgttgttagtatttgggaagaaacaacttaaaatctagtaggattgttttagaggtttgggatagtacgtttccctcagttttcttctatttcagataatgctgcttcctttactgtttcatattctatattccattaaccaccaaataatttgactctagaaccataatttactctaaaacaggagatgaggtgttttaatgcctatattaaaacaggtaacatttggccaagacatggaaatcatagataaatgagaaaggaattgcaaataaacataatgatatagataaagagtgtaatttatataagggggaaggtgataatgattaatataatagagatgtttctaacctttatttttatactatgtatacaatggtgatgacaaaaaaaagtaatgcaaagtatgcatagaatgttattagtggatagtctgggtggtagaaataaaaattatttaaatatttgataattgtctgcacttcctaaattttatacaatttttcttctttttaatttagtgtagttttctaatttctaggttatattatttaagtgagaaaaattatagaaatattacagtgtcattctaattttacagaaatcacttactattatgaaagcaatgtttcccacttttagttcagaaattagtctacagccataccaccctgaacacgcccgatctcgtctgatcgtggaagccaagcagggtggtgcctggttagtacttggatgggagttcagaaattaggggttgttggggctcagaaactgataccgcaaaatatggtgctttgacatgctgaactgaggaagaggcctcaagatctctctgagaatcacccccacttttgtcctcaatcctttgtctttcccaaagtacaggatgaagttgttatctaacattcctttgtttgccttatttgcacattaataaatttgtatgtcctttctcctctaaatctgccttttgttcactgattgtcagtgaagcgtcagaaggtgaaagggaagatttcaccatttccttcttagtcaagttatggataaattcctatagttccgccaggcgcggtggctcatgcctgtaaatcccagcactttgggaggccgaggcaggcagatcacctgaggtcgggagttcaagaccaacctgagcaacatggagaaactccgtttctactaaaatgcaaaattaggcgggtgtggtggcgcatgcctgtgatctcagctactcgggaggctgaggcaggagaatcacttgaacctgggaggcggaggttgcggtgggctgagatcaggccattgcactccaccctgggcaacaagagtgaaactctgccttaaaaaaaaataaaaaattcttatcgttccaatcgaaaacatcaggttattgcacattaattaaatttggtgagtgtatgttttgtatactgtgattctgaaaaaaaatccataacaatgtgcctttatattctgatttgattccttttttttaagacgagtctctctctgtcacccaggctggagtgcagtggtggatctcagctcactgtaacctccgtctcccaggttcaagcaattctcctgcctcagcctcctgagtagttgggactacaggggagcacgaccatgcccggctaatttttgtgttttcagtagagatggtgtttcaccatattggccagcctggtctcaaactcttgacctcgtgatccacctgccttggcctcccaaagtgctgggattacaggtgtgagccaccccttctggcctgatatgaatcttaaaataaaatctagcccctaattcttgagagaaagtttgtagtcgtggaaagaatgtggactttgaaatgaaacagatctgcattcaaatgctgagttctgtgactattttttaaatagtacttctcatatttcatattatgcaagtaacatgatagtcccccaaattccttctctttcacatcacttttctgctttgcacatcaatacatagtttatttaccctctctttgaatcttggctgtctatgtgaagtgctttactgcataaaatgcagagaacttctaagtgcaggtttaaaaagtacaggtggctttcaccttcttcctcttagaacccagcatccagaatatgagaagcctcaaccagggtgacaggccaggtggggatgctgtgtgaagaggaaaatgtcctacaactatatagcagaaccaagaaacccagctgacagtaaggacaaaatcccagacgtatgatccaagttaagccatgctaaccagcctccagttttttgaaccatcctagctggggtatcaggcatgtgatgtaaaagccattgtgaatgttttatgaccagcagcagggcaggctttatagatgtgtgacctgagcagttacacggaaggctcctatgctttaaggtttctgtgcttggcttaatgctctgctatcactaaattgaaatacttaataatttatgaacaagtccaacttcttctttttgcactggcctggtaaatcatgtattaattctgcccagcagacattatataaagctgagaccatccaaacccactatgccttgttcagatgtcttaccaagagtattttaagtgataattaaataattattgttttaatccactcagttttgggggagattgtttacagcaacagataaccaaaatacatggcatttgaaaatagcaaagaagctcacaaggagaccataaaaagagatttctttgtgaagacagggatgagaggaagatgcaagtatttatatgaagatttaagggtgttcttaaagaatatatccaaaaatgtaacgctttagaattgatgcagggcaggcaagtcccaaaattgaggcttagctagggagggtcctggcttcacacaggaaagaattcaggggcaagctggtggtgttaaacaggaacttttattgaagtggcaatgtacagcagcagcagagatactgctccttgtacagcagagctaccctgcaggcagtgtgctcagagtagcagctgaatggcaattctgcagtcatatttatatccacttttaattacatgcagactaagaggtggattatacagaaatttctaggaaagggctggtaacatccagatcgccaggtcattgccatggaaaggggcagtaacttccaggtgttgcaatggcaatgaactggcatggcacactggcatatatgtcttatggagagctacttcttccctggccatgttttagctagtcctcaatttggtctggtgtctgagttctgcctccagtgttgcatctgatctcccacatgaaaatgatagatggtgaaagaaatcaagttttttaaaacataaatatattatccaatgtatcatttgaaaaagtttaaagacttgtagctgtaaccaacacatgtaagctacccttatttgatattttaaatgttgaataatgaaaaagttactcaattaatttaaaagtggagaattttagaatgtatattttaataactagtttacaatttaaaaaacaagaaaagcatgcatgcatgcatataaaaaagttttgttagagaatgatttgaagtcacatgggatggaataaagtgatgcttataaaatagatttttgatgctgtatcttttagcaacttaaaaaaattaaaatatccaaacagttttaaatgccttaaagttctgtgtgttagcctacctgggatgaatttttatgtctgatctgaaataagattctaaattttctttttattcatttggatacccagttattctagtgccattaagcggagtcacttcttctccagtagtatgtaattccctgtaacttacatactacagtgtcatatttgtggatctgattctatgtgctttattctgttctattgtttgcttattttttcatttatcaatactacactgttttaattaccataaacttatctttaaatagaaattgcctgttttctttctcttcctccttttcttctcttttaaaattctactttttcttttttattccctttttttcctttttttttgagacagtgtctcgctttgtcgcccaggctggagctcagtgacaggatctcggctcactgcaaactcctcctcccaggttcacaccattctcctgcctcagccccagagtagctgggactacagatgcccgccaccatgcccggctaattttgtgtatttttagtaaagacgcggttcactgtgttagctaggatggtctccatctcatgacctcgtgatctgtctgcctcggcctcccaaagtgctgggattacaggttttttattcctttttaagctcatcttctcctcctcttatttattctacttttctacaagtttgtcttgtctagattagactctgcttttccatttacatttgggatcagcttatcaattacatggaaaacaattttatttatcattttgtcctgtatatctctgttctttttctggaactcttttttttttaatcatatattaaccttctccatttaaatactgtcttatatttgcagcattctctatcttttaattaaataattcgttcttgtcacatcatgttttctgttttaactatcaatgtagtattaaattgcagtatctatattttttattttcagaatttctattttttttttcaaatctactctttgttgttcatgattcttgttctgccattatgttttctttttcttctgttaacagtttatattttcgcctagtggaattaaatattcctttcattgagatctcaattctatctagccagattgctctgaactaaaacacttctttcctcttataggaagatgcactttgtatctagtggttggggactacattcaggcccaatatttctctggttattctgggtaacagctcacattttccatcctgtatttggtttctgcccttgtttccagtagttggaattaatacgtcaataattaaaagtattgatgtacttgttaattctttagttatcttttaaatataattatttgaattgctgactgcacccataatggccagcaaaacattccatttagccattctgctcccagccttggttaagcctctgttctaatgaggttataggatacgttggagccaaggtcccaagattatgacacaactcaatgttttcaaaattaaatgagtcatacagacttgattcattagattctcaactgaaataggtaagttatttcaatcatatgatacaatgattagaatcagcacaaaatatattctttagaaaaataccacttaaaagtgtaatttaatagataaggtctacaaattctttccataaataatagtcaaaaaaattctacaactttaattggcatctatattttaaatatgaaggattttggtacagaaactaattatttatgataaaactgataagtaaacatcaaattagagactgcatgtaggaatttatataattacgataattcagtaagataatttactcttttccaaataaaattaaacattgaaattttgccactttgtttttggtaagaaaacattctcacatttgcaattgtcaaaatatttaagcttattttttcattcttcttattgcatggcaccctctggtttcaactaaacacaatcttaaaatttgacaaaatattttcatgttcgaataattaatccctcattgagaaattggacactaaatacaccaaaaactgtataaaatgcttaaaagaaatggcattatcactcagcagaaatctaaatatttgaaaatattttggatattattttattttttccagatatattagtgtataatacatagaatctattagcataatactttgttaattcaaatactagtctaaaaataattattcattttcttctttgtcttaatacatcttggaacaaataataattctctattaatattatattgtgatttttctatgtaatgatacaaatagaaatctttcccgttttctatatttaaaatcattttcttaaatagtatatgatagaaacactaagtctgttataaacttctgggtcatataatgagacggtatattaaaaacaccctcttagaaaatgagaacctgtttaaaataaaagtcatcaggagtaatgtaggaaggacttcaaatacaatttgtaaaattcttatatgtagataaaaagatactaatgtcaaagtcaggaaatgctacttaaataggaaaatcccattctaacatatctgcagcagttaataaattgaacacacacacacacacacacgcacacgcacacacacagcccacatatttagcacatatcttgagttttttggaaaaaatatcgatttaaataaaataaagattgtttttgaactcgttgctttgtttgaagataccttaaaatacaatttaaagaaaatatttgagaaaattttaaacaaaactgaatcttttgaacaaatgcagacatagagaaggtcattgtatatttttagcatagaagttaaaaatataacaaaggccaggcacagttgctcacacctgtaatcccagcacttcgggaggccgaggcagtcagatcatgaggtcaggagttcaagaccagcctggccaatatggtgaaaccctgtctctactaaaaatacaaaaattagccaggtgtggtggcgtgtgcctgtagtcccagttacttgggaggctgaggcagaacaatcacttgaacccgggaggcagaggattcagtgagccgagatcgaaccactgcactccagcctgggcaacagagcaagactctgtctccaaaaaataaaataaaaataaaaataaaaaaatatatagcgaataaactcatattatcttagttgtaatcaaatcctaactctatgaacttactagcattgtgattttaggagagcagaggaaatgcagtatttgaaacaatactagttgacattttccaaaactgatttgagaagtttgctaaactcatttagaatttttttttttaaaaaaaacctcatttggacaattatatgaaaacaaatggaaacaaaattccaaagttgacttttaaaagtattaagggggtagaaggcacattatctttaaaagagcaacaaaaaagtacacatgattttttagcaaaaattatggaaatcagggtataatggaatgacatcttaatagtgctgaaataaaatgatttcaacatagaatcctatactagtaaaattatcttcaaaaagaaaaagggaaatcatttttttctggataaaaagaatctgaaagaaaatgtaatccgcagatccacactaaatagatatatgagagagagagggagagagagagaaagagatactgaagtgttattttccttcctctctaaactctaatttatattacgttatttggtctaaagaagctaatctgtgacattgtcctgagaatttcctcctctaccatagaataacatttctttctttctgtgtgatctactttttcatacgctaaccatagtctttctttgactgcacttcagtaaactcgttataatatgactcttgctttaatattaacttgtggtaagcagtagtgctaaacatttaatctgaaatttgtgataagaaatagtgttcgaatcatctttctctttctaacaattggaacattgtctgactcagtatatactctctatgtaattgatgaaaaaataaatacctttgtagtagaggctacggttaggaaattataacaatatagcctatcttctaaagtggttataacataattaagatgacttttgcacaaaattaagataagagcttttgcacattaatttgtgtagcaaatttatggactccaaatgtcagtcataaaatatataatatacacaatttgtatatgggatgtagagaaaatattgtaacaaatgaagatgctagttagttggtcttaataaaaatgttactaaatttgttcatgcttcttcatctgtcccttgagtgatagaaaaggtaatggcattttaaattttcttgagaagcgaattaatctcatagagagcactagctttgacacattgtgaaaatgaacactttaatgaacacttcaactcttttagaagttagattttacatttataacctcaaagcatataaaggcagcaaaggataatgaaagaaatcagcttagtggctgttcagagagcatggctaatcagatctccctggtttcctcaccagtgactgtgctcttgctgaggcaatggtgtccacattgtctctcagtcccacatagtcgtaagaagcctagggtaagctgattaattcccttaaatccttttgtacatcacctgaatctccagcaattttatatgattgctaaaatactgcctttaataaatgaggtcatctggatctagtctcagattcttcttctgatattagccctgggtatttcagttacatgatgaaatgaagtcattttcaatatacagcttatggagtttagagattctggtttttgaagccaaaagattcctaactaaaaaagacaggaaggatgctataagaattccatgatatttcaccctgaacttcgccgccgtttttgcttccattttggtctattaataaaaagccgcttatatgacccagacatatcatgctgtttggttacttcatatatttatgcccttttgagtaaaattgcatgtcaaagcctaccacaaagatcacagttaagtttctatggaggttttaatgatgatacatatctctatctcctcactttccccatgcaaacttcctcgttcttttttgtgccaacactttgccttttacataccatttttacaaaagtaacactttatgttaatgtctggtcctccccctgagtaggtaattcttgaggatagtaattttatctgattcacttttgtatccaatagcaactaatatggtgaaactaaagtggaagcaaagtatatattgaatgcataaaaataccataaagaaaaataaactgaacacagcaatgtcttatgcataagtactccaaaaatattttctcagctagatagctatgtcttgaggaactacttttttattattttggtgtttttctcataaaacagggtataatgaagtctgaaatcttaaaggcactttaaagcgttcccacatcaaacatttttttaatatcacaaggctactaaatattgtagggtgctagaatgcaaaacttgtcaaatatcacttttgagctatcacactgtttctctcttgaaatttacacatggtgtccaaaaaataaagtgaaagcacattggagtaaaacacataataacggtgtcataaacaaataatcaaatagactatattcaaagctaaaaatcataatgttgtttaaaattcaactgagtgaagtagtttgtatgactagtggtattaataagccactttatagaaaaaaatgcaaggtggcaaataaaaacaatgaataaaaatcatctttattataaatatgtgtaattatattttttccagcagctttaaactgacatgaatatctgcgatgagtatctctgagttctaatgttacctactatactaatagatgaggggtcattctattaaaagaatgagaatgcttcatgcacaggttatgatatcaaaaggcagcagttctttttagtaaactgaaactcctgtgacaacaagtgtggaaatttaactttgtacttttagtgaaacaagtttttggtcatgtactgaaatacaccatagtaaagaagaacttcttgctggaaatgaaaaattctaactgtctactccaactaggaatggtcatgctaaatttgaaatcccaattatagaataattatactttttttgctaaccttcactaataaaatagctattgttaatttgatttcattaattttaaagacaaataagcattacattacttcattttttgataacactttagaaagttctacttccaaagatggtaagagcagcaactttgttttgttcatttctatatcctcaggaaattattcaaggacaaggtggtttctcattaaatattttatggaatgaatgaatagatgagtatgatggttaatactgagtgtaaacttgattggattgaaggatacaaagtattaatgctgggtgtgtctgtgtgggtgttgccaaaggagattaacatttgagtcagtgggctgggaaaggcagacccacccttaatatgggtgggcacaatctaatcagttgccaatgcagctagaatataagcaggcagaaaaatgtgaaaagagagactggcctagcctcccagcctacacctttctcccatgaaagagagactccaatgtttgatgcttcctgcccttgaacattggactccaagttcttcagttttggaacttggactggctctccttgctcctcagcctgcagacgtcctattgtgggaccttgtgatcgtgtgagttaatacttaataaactcccctttacatatatatatgtgtgtgtgtgtgtgtgtacatatatatatatatgtacacacacatatatatgtatatatgtatatacatgtatatatgtacatatatatatacacatatatatatcccattaattctattcctctagagaaccctaatacaatgagtgaagaaataaattaatgacattcacaatgagtgtaggtgcagataatgaaagggtctgggaaagttggcccctcccttgaattgaataagagctcccaaagaaagagttttatattttattgaccacatattttatgcttgtcatttgtacaggttctataattgcaatgcaggttcagttattgttttttttgtttttggcaatgctgatgtatccattggaatcaagtcagagaaacagaagccacttttggatttcaaacagaatttaacaaagagaatgttgacacagttgaaattagagctaaaaaagccaaacaaaggataagacgatccagaaatctgtaatggcaggaagttgttaccatgattatgctgaaagaagaaacccagaagaccaccttactggatcttagaagccaggactacctgggagaagctggaagtacactacacaacagacctccattcatgcagtaaagggttgtttggtgggtaatggagccactgagaaaaactggccatcgctggacataacagtagaggtagagagctacagggaaaaactgtggagtgaaaaaccttgacttctcattttatcctgccttcctatttctattgagtgtgtcccattggttggcactagttgaaagccagtgggcaaggggttctggaaaatttagtttcctctgatatagataaaaaggaggaaaagttggagaatgaaactgagagcagataggtaaagtggaatgcactatgattttaagtagaaaaatgttcacttttaattctttatatgggcacattcaactttaacacagaattagatattatatttttctgattgcatttttaaaatatcctcataaaacaaaatataagaatgaactttctggagcatagatatactattttgtttttattttcccttcgtaaactatatttgttaactttgtgggtggttttataagcttcttggcaagaatgtttattgtatttgtattttctatagctattatgattgttatttaattgacagataaaaattttatgtattgatcatgtacaatatgccgttttgaaatacgtatacattgcagaatggctacactgagctaatgaacatatgcattgcctcacacacttatcacatttgtggtgacaacacaacatctactctcttagcattttttgagaatataatatattgttattaactacagtcatcatgttgcacaatagcactcttgaacttactccttctatataactgaaattttgtatcctttaaccaacatctccccaccctcacccctcacccctcaccccagcctctggtaaccaccattctactctctacttctatgaatttaacttttttagattccatatataagtgagatcatgctgtatttgtctttctgtgcttggcttatttcacttaatgtaatgttctccaagttcatccatgttttctcaaatgtcaggaattccttctttttaaagctggatgatattcctttatatgtatccaatatacaatatatgtctattatatgtacaatggtattccattgtatgtctgttatacgtatatatctcacatttcctttatctagtcatacgttgatacatattttggctgtcataaataatgctgcaatgaaaatgagagttcaggtatctttcacatactgatttcattttctttaaatacatacccaatagtgagattactggatcatacggtagttttattttcaatttttggaggaagcttcatactgttttctatagtggctacactaatttacattatccgcatcactgtacagtggtttccttctcaccacaaccttgtcaacatttattgtcttttgtattttgataatagccatcttaacaagtatgagatgatatcttgctttttaaaattttttattttattttaagttctgggatacatgtgcagaacatgcaggtttgttacatatgtatacatgtgccatggtggtttgctgcacctgtcaacccgtcatctgtcttgtggttttaatttacatttttctgatgattagtggtgtttagcatatttttcgtatacctgctgcccatttgtatgtcttcttttgagaaatgtctactcaagacctttgcccattttaaaaattaattatttggttttctaaaagtaatattgagtttcttatatattttggatattaatctcttatcagaggtatggtttgcaaatagtttctctcaatctgtatgttgcctcttcactctgttgatattttccttgagtgtgcagaagttttttagtttgatataatcccatttgcctatttttgtttttgttccctgtgcttttgcgttcatatccaaaaatgtatttcccataccaatgtcatggagctgttccccatgttcctttctagtagttttacagtttcagatcttacatttaagtctttaatcaattttgagttgatttttgtatttggtgtggaaaaaaaggtctagtttcattcttctacatatggatatccagttgtcccaacgttatttactgaagaaagtcttttccctattgtgtgttattggtgcctttgtcaaaaatcagttgatttcaaatgcatggatttatttatgagctctctattaagtttcatttctgtatgtgtccatatgctataatagtaacatgctgttttgattactatagatttgcagtacattttaaagtctggtagtgtgatgcctctagctttgttctttttactcatttttttttttttttttttgagacggagattcactcttgttgcccaggctgcagtgcaatggtacaatctcgcctcattgcaacctccacctcccggattcaagcgcgtctcctgcctcagcctcccgagtaactgggattacaggctcccaccaccacacctggctaattttttgtatttttagtagagacagggtttcaccatgttggccaggctggtctcgaactcctgacctcgtgatctgcccgcctcggcctcccaaagtgctgggactacaggtgagagccactgcacccggctcgtcttacttaatattgatttgactatttgggatctcttacggttctatatgaattttaagatttttttctatttctgtaaaaaatgtcattggaattttaataagggttatattgaatctgtagattgccttgagtagtatggacattttaacaatattatttcttctaatttatgaacatgaaatatcttttcaattatttgtgtcttctttaatttctctcatcaatgttttacagttttcagcgtacagttctttcactttcctggttaaatttattcctattttattttttctgtagctattgtaaatagaattgttttcttgatttctctttttgaatagattgtgtttattgtatagaaacatcactgatttttatatgttgattttgtaccttgtaactttactgaatttgtttattagttctagcagattttggtggagtctagtgttttctatatataagaccatgacaatttggccaagcacagtggctcacgcctgtaatctcagcacttttggtggtcgaggcaggtggatcacctgaggtcaggagtttgagaccagcctggccaacatggtgaaaccctgtctttactaaaaaaaaatacaaaaattagctgggcatggtggtgggcacctgtaatcccagctactcaggaggctgaggcaggagaatcgcttgaacccaggagacagaggttgcagtgagcagagattgcaccattgcacttcagcctgggcgacaagagcaaaactctgtctcaaaaaaaatcacaatttaactttttctattctgaagtggatgacttttatttctttctcttgcttaattgttctggctaggattccagtgttatgttgaaaagaagtagtgagaagggacatccttgtcttgttctgatcatggaggaaacactttcaaattttcagcactgagtatgatgttagctctgggcttgtcacatatgacctttattgtgttgaagtatattccctctgtatctaatttattaatagttattttcatcatgaaagaaagttaaatttgtcaatttttttgcatttattgatatgattatatggtttttgacctatatgctgttaatgtgatgtttgggaaaaatactaaaatcatgtttttcctctgccctcacaccacaacaatcaatacagaagacttctgtgatcaaatgtgtggtttattttccccattaacaagtattaaacaccagctgagtattctccaattcaattctgacactatctacctggagatagaccgcctccttgagcttgattaatttgctggagtgagtaacataactcagtgaaacacgtcgaccagtgtaatataaaggatattacaataactacaataaagagatgtgtagggctaggtgggggtaaggagcacatgtgcctgggtatgccagccgccaggaacctccatggttatctagaagcttgcctaatccagtcctcttgggttttcatggaagcttcatatgtcagccttccttccctaagggtatagggtgaaatcctctctagggagagtcttaagacctacaatcaaattatagtcctaccttgggactctagagagcaggaaaaggtcagagagattgtttccagatgcctgctcctgaggtttaacatacctaacattataacaaaagactgtaataagggctatgggaattatgagccaggaaggtgaaaaaaaacctatatatatattatatatgttatatataatatatattatataaaatatataatataatatatatattatataaaatatataatatataatatatatattatataaaatatataatatatatattatataaaatatataatatatatattatataaaatatatataatatataatatatataatatatataatatataaaatataatatgttatatataaaatgtataatatattatatataaaatatataatattatatatatatataaaatcatatcacttgtggtatttcacattcatagatttgcatgtgttaaatcatccttgcatccctgggataaatcccacttgatcgtgataaatgatcctcataatatccttttgaatttgatttgctagtattttgttgagaatttttatttctgtgttaatcaaggatagtgacttgtaatttctttttcttgtcatatccttatttggctttgttattagggtaatgctggcctcataaagtgtatttggaaaaattttttgttcttcaattttttgaaatagtttgagaagatttggtgttaggtttttaaatgtttggtagaattcagcaataaagccatcaagtcctgggcttttctttgatgagatagttttattactaattcaatctcatcactcattattggtctattcatattttctatttcttcataattcagtcttggtaggttgtatgtgtctaggaatttattcatttcttctaatcttcctaaattgttgatacataattgttcatagtactctgttactgttctttttatgatattagttgtctttttaatttctaattttatctatttgacttttctccctttcttagtctagctaatgatttattttgtctaccttttcaaaaaaaacagctcttacttttgttaattttttttcggccgggagcagtggctcacgcctgtaatcccagcactttcggaggccgaggtaggcagatcaccaggtcaggagattgagaccatcctagttaacacggtgaaaccccgtctctactaaaaatataaaaaattagccgggcgtggcggcgggcgcctgtagtcccagctactcgggaggctgaggcaggagaatggcgtgaacccgggaggcagggcctgcagtgagccgagattgtgccactgcactccagcctgggcgacagagtgagactctgtctcaaaaaaaaaaaaaaattctattgttcttctagtctctatttcattaatttatgctctgatctttattacattcttctttctactcactttgagcttacggtcttccttttctcgtttttatgtagataatgttaggttgtttacttgagatctttttttttttttgatgtaggcatttattgctatcagattccttcttagaactgctttcactgcatcatatacagtttgatatgctgtatttccattgttgtttgtgtcaagataatttttaaattttctttttgccctatttagtgttcaggaacttgttgtttaatttccatgtatttgggaatttttctaaattcttccaattgatttctagcttcatgaagcatagaagcacttttttattgaagataaaattacagatttagtatttgagaaaccaaaaaaatggtgtcaactaccacattttttcaggaataataatatattttttgcttgctgcttagaataactcaaagcaacatagacaatattttatgacacagtttaaaagcaagatgacttaatatttaacaattgtataatattttaattagcccaaaatacttttttcctagattttaaagatgtttacattttgtcacatttgtcatttaaaagagaaaattatagatacagttgaatgtccatttctgcagtcaatccttgtacctccctttttaaaggcatatagtctatcgacatttataggattgttagttcagattttaagtttacatacattataccaaatggtaataaacttttagaactggccattctaactcaacatgattatatatttaccaatgttgatatgtctagaacttgttcattctttcattttagttgtgcatagtatgctgttggacagtatactattatttatcttttgtataaatttgatgaagtttatatattctaggttctgtttttcagttgattatgttgaaaatattttccttcagtctgtgttgtagttttggctaaaaaattttaatagaaaaatataactcatttttcttacacattattttaactacaggaagagaaaaaaaaccccagaacattaagtaagactactgaaacaagctaaataggtgatattgcatgtaaacatacatacatctttctattcatagacaagacacaataaaaaatcttggatgaaatacttcgatttgcatatattacacattttcttttttgctggttgattaatgactgcaaagaaacttgaactcattttatgtggagaacactggtaaagaaaaagacacaagaaattctgaaaaagtacctgaaagtgaagatcctaagagtgaattggatcttattaaataaaaagctgttgtttctattctgtggtatttagagttgggagtggttatatgcatgttatttattcactcatacagtcatttaagagttttattttcttaattatttagtaaaatttaccaatacgaggtaagaatcaaggtgaagacttatttttatttaagtggaaagtaatacaaagttttatagttgaaggaaacagtttgcagctgagtttgcagccattttattttggaggtcccttggattttcccagtaggttctggagtcatttctacattttttcttatgaaatttggtgattattatgttaagtattggtaaatgtggtcatatcaaaactatgttatttgtattctggcaaacttttacactaatcatacattgtatgacaagcaagaatttcaaggaagtacctagtctggtctcttttatgcctgattatttttatgtctatatccatataactctccgttatgatactctgtttctctaaacagtgtatctctcagtttattctctttttttaattaaaattggagacacaacaggatagaaattgtgtgttttgttcaaatggtgtgccttcaactcatagaaaagtgtgtgacatataaatgacatcctgtttatattcattgaatatttgctgaataaatggaacaaacaaggcctaaacagttacatcattcccccaaatcatacaaagtattttttctgtgacaacccatttcccctccatactcctcagtctgacaatttagtgtttcggacccctgttcctttcatccacatctccctagtctactgaaacattcagaactactctgcctttttctttccagctcctaattatactcctagattttactaaggcagtttaatattttatttcttcacaagttgtataatctcttagaaagttatattccatattcctgacagatagtgtatcattatcccttcagatttagctgcatttgtactgctagggttattactaatcttttctttctttttattttccttatctcaaattctcagctctagtaaatctgtgctttaactataattttttaaaactattatcctcaaatgatgaatgtgggtgataaactctctgaatatttgactattaacaaatatctttctctcttccaggagactggtatcttgtctgtctaaagaatgattagtttatcatcctattttctcagtagtctgagtattaatcctttgctttctagcagataagaagttggacacaaatgattcttattctttgcaagtgacttgttctttctacctggaagcttgtaacgcttccttataattttgcagttcaaaaattcagattgtgccttcacataaatctatttcatcaacattacttggaatttgatgaggcattttaatctgcaagcttaaatatttatttagcttggagaaaatttcttttactatttgatcatttcatcttttccatgtagtcttttttccttctgctagaactaatattcttcaaatgttacattagttgcctgtactatcctttacatctctcatcttcactcacattttccatgtgttagtgcttttgtgttgctttttgtggtatttcttcctctggatcctctatttgagatttcaagtgtccataccctaatatatctgcagagtgtcttttattgtgaagatgtgttttattttcagaaatatttcctataaatgttcttccttaaaagttcttcctcagaggttctatttaaataaagaactatgctaaatgttttgttgctcttctttgaacagactgttggaccctcaggtgaatgattacgtgtttgttcttctcactatatctcaggtgcagttgccatagtactgtcctgggttgagaaaatggaattggaatggagatttgtgtgcactgtctttaatagggagtggtttttggactaacacctatggacagttgaaagccacctttggtagtacttttgaaagctggcgaatatgttcatcattcctgagggcaatctggacagtgaacgaacatcactataatttcaggcagcagtgaacgtgatggagagaaccagtgtctctcctgttataagccaatagcagcagcagcagcagattattagaccctatcactgctaccaggaaaaatccactttggctccttggattctctcagcttaaaagctaaagaaggcttggcttcctttccaatttctcagaaaattttgaacagaaacatgaggcatagtcgcattaacttatagggatttccaaattatggaaagtcatgcttatgcacaaccatggatcctagatacagttctttgaacccagtctactgcctggctaggaaggaaagagggcttcaaactgttggcttcattcagggtttgcctgttgtcctcaaaaaagacagaaggattggttctgtctttacaatatatctacctcacctcctctaactagggccaagccattattgtttctctcctagagcccagtaataccctctcaactattcttcctgctttcatacttacccattttagtcttaatattgtagccagagtgatctttttaaaatataagtcagattatgtcactcctctagtcaaaatttttttctatttcacttgtagcaagtcagtccttaaaatagcacaagactcagtacaatctctactagtcacctctctctgccccctccaccacccacatatatctctaacttcatctactttcttctccttagtctttcatggtttttcattggtgttctttagcttttaagactttgcactagctttctctctgcctggaatgtcattccatcaaatattcacaatgggaattcccttatctcttttgtcaaatgtcactatctcagtgaggcttaccctgaacaccccctcctccaatttaaaattaaaactagccccatttttatgctactgaattcccttaacttgctttaatttttcaccttctaacaaatgatgtaatttatttatttaccatatttattttaactgtgggcctctctgctgtaatttaacaaggttacatctttttcaatgattgactcatgcatctagaggagtgtctgacctctgatacatagtacaggctaaaataaaaagtggccacatgaataaataaatgtatgaatgaatgaatatgaagaagcttagacaatttcagccttctctcttcctatcacctttgatcctttatggaaattttctctaatcttcacaataatcctgcaatactgacattaatttatccattccactgattaaaaaccaaggctcagctaatgagtgaaatatccaagattcaaattcaaatctgtctggcttccaaccttatgtatttttgtttgtttgtttttgttttcttccccatgatccaaagctctttctaaatggtaatgattgagaactaatgaatgtagaaaagatggttctaagaatgactgtttctcctgtgtatagtggacagcctctcctcatgaaggagattaattcctcaattggggtgagaaagacagggactttcctttcatctataatatttaaactcctcaattcctgtcccttctcctcacctgggaaacatttattatcctgtcctttaaaattgtgtgtactgaagagacattggaggaaacattctaagttctttgcccttctagagtcattctctatcattctcatcacatagtcactagaaatcagtatggaacagaatcatggtgctgttgcaaaatttacaattaacagtgtgaattaacaattaacagtgctaaatttctctcataaaacagtgcagcaaaattaccaactaaaaaatgtgtcaatatttattgcctatgacaagtttgtccttcatttaaaaaattttgctttcaattcttccccaaattatcctttttttcaccataaatcacatgtttatattatagctatcaaaggaattacatgtgattttgtttaggtacttttttttttagaaaaatgattttattaaggcataattgacacactataaactgtacacatttaaagtgtgtaaattggtaggtttatgacatatgtgaatagctgtaaaaccatcaacataagcaagataatgactatacctatcacaaaagtctgcatttaccccttttcagtcttttagtttcttcctgtctcccctcatcttcaatcgctgagttatttgttgtcactatagattagtttgcactttctataatttaacataaatgaaattatatcctatgttgtctttttcttttggctttttttactcagcatatttgagagccatttatgttattgcatataaagatgggtaattctttttaattgccaactagtatttcattctttagatgtactacaatttgtctatccattcaattattggtagaatttttatttttcagtttttggctattacaaataaagcggctatgagcataataaagcatctatgaactattctttgtttgaatatatgctttttttttttaggtaaatacctaggaatacaatggttgtattacatggtaggtaaatatttaaattttaaagaatctgccaaactgttttccaatgttgtggtaatattttacattcctgttagtagtgtatgagggtttctgttgttccaccttcttgccaacacttggtatgcccagtctgttttagttttagcttctaattctttggcagttgtatatcattgtggctttaatttgaacttttctaataactaacaatactgagcaccttttcatgggcttaattgccatccatatatcattttggtgaagtgattgtttcaaatgttttgcctaataattttatttcgtggtttgctttcttattattgaattttggaagtcctttatatattctggatacaagtcatctaccagacatgttatttgcagatgcgtcctgccgttctgtagcttgtcttttcatactttatacaatctctttagaaagcaaaaattcttaattttgattaatcaaatttattatgtttttcttttcgtggtctgtgttttgatattctatgtaaaatatctatctttagtgcttctcaactgggggcaattttctcaattcccccagttcacatttggcaaagtctggaaacatttttggtcatcacaattagtgtcagtggggggttgctactggcatgtagggtagaggcaagagaaaatgttaaacatcctgcaacacacagaaaatgtcaccccctacatacatgcgtgtgcacacgctccctctccgccccgtcccaccccatgcaaaagaattgtctagtcccaaatgtcaatagtgccaaggttgaaaactctaatcacaaggatttgtgttttttcttctagaagttttatagctttttattttacacttgatatttggcatttcattttcattcaattgaaaatacattctaaaattccctttacgatttcctctttcacatatgagtttttataaatgtgatattcatatttacaaataaatatgtggttatgtgggtattttcagatattcgaatattttccacatattttctcactattgatttttctattaataatttaactgtcatcaaataatgtatttttgtactctcctcactctattgttgagtattctaaaaatttaaataagatcagttggttgttcaccttttagaaacttctacatccttacttaattttttatctactttctatcagtcatggagagagtggtattaaaatctccaactacatttgtggatttgtatatttctgcttaaagttctattaatttttgctccaggtgtttcgaagctctattgataagtgcataagcatttaggattgttaaaacctctcaatgaattgaccctgttattataatgaagtggtactttttatccctggtaatatttttcctctgaattctcctgtgtctgatattaatatagacattatatctttccttggattagtgttaagatgccatgcccttttccatctttttgtttttaatatatttgtttatttatacttaagggtttttttgtagaccatatacagtgtgttcttgcttttttaaatttactcaataatctctgcctttttgagttttttgatcattaatatttaatatgattattgatatgattgtattttaatctgccatcttattatttgttttctgtttgtgctgttctttttatgcccttttctcatttcccatcttctgttgggttgagtgctttttttacaatttgattttctatttttttcattagtttattactcttgttttcttgactgttgctttactgtttaatagtatgcacatttaatctattgtagtctaccccaaataagatatcaatttctgtgtagtataagaaacttacaacaggatgcctccatttcccctttaaactttttgatctttttatactttttaattctacatatgttataaccccaactatacattatcatttttgctttaaacagtcaaataccttttaaacattttaaactatttttaagtccttttatttactcacatacttacatttcagttctcatcattcagttgcacagatccaatttccatatggtatcattttctctgtctgaaggacttgcttcaacatattttttgactgatggtaataaagttgttgtcagttatatgtctaaaaacgtctttgtgtctttgccttcatttttgaaacatattttctctgagcatagagttgtagattgacagttttttttcgttgaacaacatccgtaaaaagatgttgatctaatgtcttttggcttgcattgtttccagtgagaattttgctgtcatctttatttttgttcctcttaatgtaatgtgtcttttttactgtttttgagatttcctctttatcactggttttaaacaatttgattatgatgtagtttgatgtagtttgcttcatgtttcttatgcttgaaaatttgttgagaatcttggatttgtgggcttacaattttcatcaaatttagaaaagatttagtcattatgtcttcaaataatttttgttttactcctttcctttgaaggctctgattacatgtatattagaccacttgaaatgtactacaactcactgaagttgtgctcttttttttttttttaagacttttctctgagtgtttcattttggatagttcgtattgtgtattcaggcacaaaagtctctttgtctgctatgtctaatctactggtaattctaaatcggtattttaaatcttagatattaaagttttaagatctaggattctgtcttttgtatttttaatatcgtttttatctctatttaatgtgttcaatcttctctctagtttcttgtacacatggaatacacttataattcagttttcaagttcttgtctgctaattccattatctgagtcatttctgggttggtttatattgatttatttgttttcctcattatgagttatattttcatgcctccttgcagaacagattggatgccagacattatgtattttaccttattagatgttggatatctacctattcctataaatattcttgaactctttttctgggaaacggttacatcatttagaaaccatttggtcattcgtctcttgcttttaaggctttttagcctttatcaaagcaacatttattctagggttaattttgctctaccagtgatttaaaaccttttttagcagtctagctaattcaccattaattagtaaaatttctactctggattttggtaaaagtaactattcctggctatgtgttaactcctgggtttattccctctaatccttttgggtggctcttttcttggccttgggtagtttcttcacatggatgtactaatcagtactcagcagagaacttaagtaggccaaggctctaaagcttctttctatgaagctcattcctgtcacatacccagccctgaaaactctagccacctttacctccctggactcccaactcagtttgctcatatcagggagatcattaagtccttcctgtgtttcctgtcctggcatcgaggcccaatgagtctttccaggtagtaagatagggcaattatcagcctcatctcatttgtttcatgtctctcaaagatcactgtctttaattaggggatctccaatgtcttaaaaacccataatttttgtatgattcttaaaattttcttttcagtcatgaagttacatcttgtccatattacttcattttagccagaagcagaagtgggtttactacacgtgatttttctcaaatactttaaattccaaaggtaaattccaaacaatactagtaaactactttttaaccctaaatattgccttaataataaagttcaaaattgatgtttctattaagaatacctcctttcttttagaagagcattgtagttggctttgactaccatagtagtataaaacctgacagttcttattcaccctctgtagttgtcaggattaatttacaaatgacattgaattttgggagttttacttttatctgaggcttctatcagaggtgtacaaaaaggaaaaaaaaggaaaaatcttccatgctgtattgcttctcattttcagccttgtaagttcatcagcaatttaaagaatttaatcaacacattttcagttttccttcacctttttattgaatgagaaactgaagcaaaacagagttcctcagtcaagaaggagcagagctggcattcaagcctgttatcctatttttgtttctcagtaagatatcagatttctatattgtttcacacttgattttttaggacttgaggtcaaacttttactagattcactgatcagtgttaacttatgttagcgctaagtaaaagtataaaaacgtccttatacaatttcagaattttaaggtaatccaactaattttattcaatttatttattttacaggtggagacataaaatttaaattgctctaagcaaactagctagataggactaaactgactattacacaaattatttttgatattttaaataaaaatgttatatggccaaattaaaaacaagctatcatttggataaagagatgtttctttctttctgctacctaatttttctaaaatggttatttgaaaaaatacctttgtctcaatttcattcttccgacttctactccatttaaacaaaataatagattagaaacataagtaaagagatttgtattatttttatcattttatcacctataaataaacaattctgctaatgcaagaaaaaatagagtggatactcaattaactgcaataatgaggaagtcatagataaaacatcattagaactaagtccagtcttgccactcaaaaaagtgtgatgcaagaatcagttgcgtaggtattaggtgggagcttgttagaaacgcagaatcttaggcccagctccagatctgcttactcggaatttgcattctaacaaaatctccgtgtgattagtgggcacagtaaagtctgagaagcattgctcatcctggttttgcagctgtgtccttcttctgttcatttatctccccaggaaaaagctttataatctgggtaattatccttgattagcaacccttataggaggtagtaaaggggacattaaagcttaaactccaaattactgactgcaaactgagaaatatcacctgcttgattccttaacaccctcccactccctagccagctctttcagaatatctgaaactagttaattttctgagcaatcaagagttgtctgtatctaagaatattttgtgattttatttgtgctttcatgttcttcttcctcctgtttctacagatttttttccttaaaaatctttcatttaaaaatctgtagaacttaaagttaattaatataatcaaaaaagttacagacgttgaactattttactatttgtagttaagttcctaaagattgtgaaatgaaccacataaattagaatttacttggattggaattatacatgtttcagatatgatcaaaatcaacacttctgaaataaaatcaaagagcaaataaatggtgtgcttgagagataatataaaatgctgaaataattttgtgatgaactttgatcagataaattcaaatatcaaattatccacattattatcttactgacagaaagcataaatataaaaaatatcttattgagtttctatatgatccacatactaagtgatgaaatctataaaggcatggtagtttggtataagtattagagtcatcagttctagactggtttgttctcaatgagaagaaaaaggccttctctgcattgtgaatttaaatattttgctgttccacaagactgggagctctaacatggttcacagggaccaaaaattaagctcagctcagtgccaggaacagattacaattcacatattccgtggaatgactgaagaaatgttgtccgtgatatttgactagttactgtcctgcactatttgcagacagcaccatctgttattattgctgaccttccatttttcatcccaaactttcaactactaaagttactaaaaagatagaaaataaataaacatatagcactatctctaaagagctacactgaaatacatatattggaggtagttctctatccctctattgcaatagcattaaattctggctatacttattttgggaggccaaggcaggtggattgcctgagctcaggatttcgagatcagcctgggcaacatggtgaaacccatctctactaaaatacaaaacattagccgggtgtggcggcgtgcaactgcagtcccaattactcaggaggctgaggcaagagaactaattgaacctgggaggcggaggttgcagtgagcagagatcgcaccactgcactccagcctgggtgacagagcaagactccatctcaaaaaaaaataaaataaaattctggctatattttacgattgtttggaaactccaactgtgcaattgttggaacctaaaaacatgtctaggccttatgccaaagtagttctaccaaaatgtatatatttatatggtgtcatatatttgattatgctttatgttccttgatctctaaatggatgcaaaccaatccataaacttcaagcaagccagcttgccaacacaaatcacaggaatcagtcaatgagcagggatgtgataattatgtgggcaagtagagctagtcagacatgggaagcttgtaccttgctctggatttttttctgtttgttttccacatctattttgtgtcccactctgggagagaaatatgtcatagagtaatttaatgctagtagcctagtgcttaacaatttagtactatatagtggtacctaagttaatgtcgaggcctgtaaaaacgcaaatcactagccctgatattctccacctgctcccacagcagtctcatatttaggcagttttttgctttctgtagttttgtgtttatgtggctttttttcttatcttctgctacctctcctttctacccctaattctaatagtattggtccatcttactaacagcaaatgaattccttgaatctcaactggagtggcgtagtcctcttagtgaagttccatctgtgacttcagaggctccaatcttacttcacaggggcttattggagcattttgttaaaacacgtgctatgcaactccaagggattgtatcagtccagatagcataggttatgctgcagcaacgtattagtctgttttcatgctgctgataaagacatacctgagaatgggcaatttacaaaagaaagaattttattggacttacagttccacatggccagggaggcctcacaatcacggcagaaggtgaaaggcaggtctcatatggcagcagacaagaaaagagagcttgtgcatggaacctcccctttttaaaaccatcagatctcgtgagacgtattcactatcacgagaacagaaagcatgggaaagacctgcccccaagattcaattacctcccactgggtccctcccacaacatgcgggaattcaagatgagagttgggtggggacacagccaaaccataacaagtaacaaataatccctaagtctcagaggcttagtaacaaaagtttagtcctcactcaccttacatgttcaatccaggtcagctatgattctaagtattttttacttgaagattcaggaagatattgctgcttctagcagaaatgctaatagtcaatttctttttttcctttttccttggaaaaaggaaagtagaatgataaactccatgttggcctatgtgatatgcatcacttaacctcatgtctcattagttaatcaagtcatgcaggcacatatggcatcaatacgttaaggaagctatgatttctcttcttcaaacagaaaggacagtgagtatttatgcataataatacactctaccatagaggcattgtggcaaataaaattttatccacctcattatgtgtaatattattcttttttgttcttgtttattcatatttatttcttcatgaaactgagattccttcaatcaagaaagtaattttattagttttgtttccttagctcttattccctgacatatagcaggcatttgacaactgtttactgaatcaattaaagataaacattattaaatcatagctatatctagagcttgctgaacattgatgtttctataataaaaccgtatgattcttaggtacaagcacttctaacataaatagccatgcactcagatgatatcctgatattatctgccaaacacatattatcgccaggtatgtggcagagcctatatcacaatcattaaagaagctctcaagaagtttgttgggagaataataaagttttgacttctgccaaaaacattctgtgcacgagtcttacaattttattttaaaaaatggttggagggagtttgtttgccttgccttttttgttagtaaaataaagtgtgtcacaggcccaaaggaatttgaaatatttctgaaaagacactaaactgtgtaggacaccacagatgaggctcccttttgccttctcaaaaataaatgtgcacagtttatcttcttgtatgattaattactgtagacttaattatatagaataaatctgtatcatgtaagagggaaaaacatctgaaataataaatgcttttaaaatgttaggttattttatgataacattatcatcataaaaacaatattattttaccttttgaaattctatcccaatacagaaagacaggaatgataaaggtaattttctatgaaatggtgtgagagcttattaaaccaatactgttttgcatttcagatagtattgtataaagagatgaatcgattttttaaaaaaaattacaacagacaaatattaaatacttatttcctatatggatataaatattaattaggtagaagtgatatatgttgaaatgaaagaatttgaattagttatgtgaaataaaatgcatgagtaaaagagtgtcttacatggagacataagtaaagtcaaagccttaattaaacaaaaacagaaaaagggggcagatctcccacctgctcaatgatgcctgaaattgagctgtgggaacataattcctttcccttaaagtgtaaatttgtgtaaaaatgactctataaaataataaaaattatctctttaaaattgcagatgactcgaaaggtagagacagaatatcatcatacccacactcaggttttctaaaatatggatgaatcatactggtgggaacctgattagtcagaaactaagaaatcagtactactacttaaaagctgtcaggccaggtgccgtggctcatgcccgtaatcccagcactttgggaggccactgctggaggatcgcttgagcccaagaggttgagaacagcctgggcaacatggggagaccctgtctgtacaaaagacaaaaattagctaggtgtagcggtgcacacctgtggtctgagctactaggaaggctgaggtgggaggatcactggaacaccagaggttgaggctgcagtgagctgtgattgtgctgctgcactttagcctgggcaataagtgagaccctgtctcaaaaaaaaaaaaaaaaaaatatatatatatatatatatgtgtgtgtgtgtgtgtgtgtgtgtatatgtatgtatatatatatataatatatatattttaaaaagctgtcaataccttctcagttttggaatggacagtgggtcatcttaaagcacaccatacttttttggagaagaagcacttacatgtctttttcttagtgatatgaatttaggatgatgattttgtagttgctattttttccttataaaagctgtctctttaatcttcttgtcaggaaatgttcagtcttctgaaaagaatagagaaaaattagcataatacctgaggagacttgaaggaaaacgggtatagaaataattgtcttttatggttgagttttattataatcactcttatggtttgagctggaccttccttaaaaggacaaaggacactagacactccccaaggaaactcatcatgatcacaggggtaggaatcagagtcaagaatgacaggggtagggagagctgggatggcaccacatgtgacgaagattacatgccactttggatctagcagccattgcaaggagagtagagctcacaatgtgatgagtcacaaccttaggagcccacatggaaaacactgttaggaataagatagtcggatttaggagtagatgagatttcctccctggaaagaccacatcaacctgcttcacaaatctagagcaacaaggaaataggagaaagttgcacagtgagtgctaagctgagtttcttttatgatttttacaagtagtagtatcattataaaatatacatacaggaaattatgcaaaataatttaagaaacatttgagtatctcataattttgacaaacattaatgttatgccaggctttcttcaaattctttctttttaaccttaagatatatttgaaatttcttcttatactcctccctggccccatttccttcattaattgttcttttttttttttttctttctggtgttaaactaatttctttgctttatttttttcctccagctttattgatgtataattggtatcttcaaattatatcttctgttaacgagaatttgatatttattattcttatatataacatattcactttattatatatatctaaaaataatgtattttatttatttttaaatggtgtaaaatgtataaaaatgtataaatgatatcaaattgacatactgatctgtaactttttttttcaagatttttctggtgtttttgtttgtttgttgtcattgttgtttttgagatggagtctggagtctcgctctgttactcaggctggagtgcagtggcaatattacagataactgcagtcttgaactcctgaacccaatcagtcctcctgctttagtctcctgaatagctgagactacaggggcatgccatccctcccagctatttttcttttttttctattttttatttttttctacagtaagaggaaggtctgagtatattccccaggctggtctggaacttctggcctcaggcaatcctctcacttcatccacccaaaatactgggattacagacatgagtcaccacacccagtttgcccttgttgataggtgaaactgtaaaattttctgttatatgactatacttatttagttctttgttgatggacatttaacatgtttctaaatttttccctttaggcgtatgagctgttataacatatgggtgaggaggatggactctgggaccagactatctgctttaaatctgtttcaccacttatcagctctatgaacatggcaaatttcttcctcttttgtatctcaatttcttcatctgtaaatgaggataaaattaggatctacttcagagggttattgtgaagctgaaaagagttactataggtaaaacactgtagaatgggtgctacataataatatcgtacatatcatacagtgatttaaaaaatcattctcatacatatgtcttatacaaaaaatgtgagaatttctctaggatacattcctaggagtgaaagtttgactcttagatcacgtacacctccaacttatgagatattgcaaaatttctttccagaggaaatgtgtatttccttcagcaatgaatgaggataattatttcttcactttctttccagtatgaaacatttttaaaaaatgtttaccagtttgatgaatatgaaatcacattttattgtggttttattttttatttctctaattactagagattgagcagcttttcatctgcttattaggtacttgagtttctccttttgcagtttgcctgttcctagcctttttgatggttgtttttgctttaattagattttctctttcttattgatttgtaggtaaccttcatattttccaaatattagtaatggttagactttccttttcacattttataaggtcacttttagtagtaaagttttaaattctaatgtagtcaaagttacccatcttttttattggagattacacattttatgtttgtttaataaattcatttgacctggagtcctaaatacaggccactacccttacttccagaagggataaaagttgatttttatattaagatatttactcacttggaatttatttttgtacataaaataacatagaaaaatgagatcattttgtttcatatgaattactgatttttctagcactatttataaaatagttcatcattttacttttgttaaaatgccaatgatcaaatacctgtattctgtttcattaatcacttgtctatccctgcaatgtagtatttaaaatggtatggttataatgataaccattttaaatactagagctttaaaataatttttttgtgtgatttggcaatgtcttggtttatcaggatgttataacaaaacatcataaactgagtggcttacaagcaacagaaatttatttctcattttggagaccgggaagttcaagatcacaggcaccagcagatttcatttctgatgagagctcatttcctcatttatagaatagtgctttcttggcagtatcctcacacagtgaaaggggtaaacaagctccctcacacttcttttctgaaggcactaatccaatcacctcccaaaggccccacttcttaacactatcacctttggggttagaatttccacaaatgaatttgggggaacacaacattttggccacagcaggttaatattcctatttttctattcttcttgattttttttcactttttttggccgttttgttctgcaatatatgttttaaatcaacccatcaagctcccagaaaagctctgccgagattttaattaggagtgcattaaatttgtagattaattcaggttcaatagaagcctttctaagccattcggattttattctgttggctaaaggtaaccagttcaggatgatcatgatcttatatgcattttagaatgatggctcttatagaaaacttgaagtagtggaagtctgatgcaacttgttttgtggatcatgttgactgccaccacaaaacaggcaaaacttcaaagaagtctaatttgttcttattcctctcagaagcctcttcctgaattcttccttacttgcctcttcctcactcctcaaacatccgtattatacatagttaatatttatgggtaaatatggataaatacaggtaaaaatgattactatttatggagcaaacactgtgttgaaatcaccttgcagggttaatgagaattctggaaagaaatataattaagcatttatcaggcttcactttgacccacttcctgtaaccaaaagtcatgtagcactagatactgacatttgcattccctttgtttctatagatgggatttctgactttagaatcataaggtttttctttaatataggtaggacttctgacattagaatcatatgtcttttgtttaagaattgtttaagatgcttttcagattccaaattccagtgaaatagctggtgccaactggtttaaagacccccaccaagaaacagaatcagcatactacagtttcttcatctccctgtcccatcacttcaccctgcactcttggatcaatcaacaatctctatacatttgccctctaaaaccctgaaaaccccccagccccaaactcctcaggaagatggatttaaggtttcctcctgtctcctcatttggtggccctatgattaaacctgtttctctgttgtattgcgtatttacttgccttgtgcatcgggcaacagacctgttacagttacagtgttaaaatctttacatgaattatttcacctacttccacccataaagtagacagaactagatttagaggtgaatcagccaggtatgtgtagattatcaatcttaagaagggcactcacaatgattggaaaaaaatgggattatggtttcagttaactcaaatgtccatactctttctccacatgttagaggaaaggggtcctgatccagaccccaagagaggggtcttggaactcacacaagaaagaattcagggtgagtccatagagtaaagtgaaaataagtttattaagaaagtaaagcaatgaaagaatggcttcttcatggacagagcagccccaagggttgctggttgctcatttttatggttatttcctgatgatatgctaaacatatcatcccctttctagaccatatagggtaactccccgttagttgtagggtatgcctctcctttctagaccacatagggtagcttcctgacattgctatggcatttgtaaactgtcatggcgctgatgacagtgtagcagtgaggacgaccagaggtcactcttgtggccatcttagttttggtggtataatgctggcttctttactgcaacctgtttatcagtaaggtctttatgacctatgtcttgtgctggcttcctatctcatcctgtaagttagaatgccttaaccatctgggaatgcagcccagtaggtctcagctttattttacccagctcctatttaagatggagttgctctggttcacatgcctctgagattttccccatccctttcttttatttatttatttatttatttttgagatggagtttagctcttgttgcccaggctggagtataatagcaagttctcagcccactgcaacctccacctcccaggttcaaggttcaaggcctcagcctcccaagtagctgggattacaagcacctgccaccgcacccagataatttttgtatttttagtagagatggagtttcatcatgttggtcaggctggttttgaactcctgacctcaggtgatcctaccccctcagcctcccaaactccttggattacaggcatgagccaccatgcccccatcccccactccccctaccctcgccacttttataagacaactgttaatcctaagggttgcagagggacaaagctccatcttctgtaactacttcaggctgaataggggcaatcatattcctgcctaactattagggtctcttattttcagggtagaggggagctcagtcagaaagcattggtatggtgagggccattcataactcccagttcagacaaaagataatatctggaagattaataagtgttcaatttaagaaaacattcagtaagcttgtcctgcattcctacacaaagagtacaacagcagtatattccacaagagtaaacaaaatgagtaaaattattccaagtaaactagattagaaggctttccatgaactgagcaactgttggaactaagctgatatgaggttgctagctgattccaatatgcccaagattagaatattgatccagatttttacatcacttatccctcttgtttcttctgaatagcatccagaaatcactggttggttcacaggaataagcagggttaacctaaattgcaaaaacaaacttaaaaacaactcatgagactagaatttaataacaagtgtgtcatagtttttgaaacataattcctctctccagtttcccatttttactaaagacaaatcatgataggacagatttattttattatacttggcctaattatttgtaaaagtgcaggaagaataattatttcttacataagcttttttgaaattggctttgatggaactctgttccttagaaggaatcttagatgagacttttttttagcgctgagccctgccatggggttgtaccctcaaataactatgagttgggaaaattcctctcctcttggggtaccaagataacccagggctcctagacctgttagaaagtgacattctttacttatcacaggtcagaaaccctgtacagggattgtgtaggcaaggtatgaggccagttctccaaagggcttttattggttttacaagtgaagtctgattccttaaaggaaaccacaccattccagtcaaagccttggtaaaatatccagtttttttcaattgtgtcctgttatcacagcaaacagatgcttactgcacttatgcaaataactatattgtcataaattaagaacactcacaaatagtttccaaattttggagaaatcaggtagagagaaacaaatatgcttcaaattttattcacagaagtatacattactcagttgttaaaagctgtaaatagcttaaaatagaagtttccatgactctgaaaaacaaaacaaaggatcagaaatggatttgttttgtttgtttttgagaccgagtcttgctctgtcacccagactggagtgcagtggcatgatctcggctcactgcaagctctgcctcctgggttcatgccattcccctgcctcagcttcccgagtagctgggactacaggtgcctgccaccatgcctggctaatttttttttgtatttttagtagagacagggtttcaccgtgttagccaggatggtctcgatctcctgacctcatgatccgcccgtcttggcctcctaaactgctaggattacaggcgtgagccaccgcacccggccaggatcagaaatgtttaaagcaaaatcacaaagattacttcagacttatttagtttatgccatgcagttaactactgttctgtttgatattcatgaatattttagctctccctgagaatccttaattttttttcatttattcggatgtcataatctccaaagttaccagaaacctgcatttaagaacacctgatagaactctatagttgactaaaaactgccttctaaagaggaccaaaacaagacaacaattgtctgtggctgacaaaatgttttagggcagcaacagtcaaagacacaattgacaagaaaatttggttatctctgtatcatacaatgattttatgtaacaatttttaatacatacactaagtcatatcaaaattataggagtttcccataattttgaaacatataccaataatgcatttatacaaatacagctcaaaaaaagccaaacaccatttcatatttgacaatgattcctgtataacttttataccaagtaagccaaatgccactgttgcattagtgcattattgatgtcaaaccaaatttttaataaaaccttagagacaaatgtatttaatcttaattagtttgaccataaggtaagattttgataaactttttataaccctttcctttacaaatttttgttaaagagtgcattataagcaagtttttactctaagaaaaaccggttgtgcttttatttcaatgtataatttacagaaaaactgtataatacccctttaactttagtcaatatgtttacacacagaatctcttttacaattaatttttcacaaaccttccaccatttgcttaagccttcagctttatactaaattaaaataatcctttaaccctttaatgtaggcaagaaaaattcacattcccatgccttcttataatcttttgccaaaagtacattctactttccttacacaacttgcatgtagaactgtttcttcagtagtctcaaatacatggtatactgttaacccttggtgacttaactattggtgaaaaccttggtaagttcaggattctaattatgcagtaggtgtggggcctagcctaggacacaccaggcagaagtgcaggtaagggctgactccagcatagctagggagtgtggctaactccacatgtccccaggccttatctagaatctaatgtctctaaagaaggtaaattgaacaattttcaaaagtcaaagaagcagtttatgaacttaaagcattaggaaacttactatctgacctgcataatttagaacaaatgtttacattttaccaataatctttaaagctgtttttatttcctaaagattactaaagtcacatgaactaaataaaaggcattatactttttacttttctggcaaaatattttatttaagctcttattatttttaaaccaattaaagctcttttatataacacacacagcacgtataaatacacagacagacagaagaaaaaggactcatcctctaagcgggaaattgaaccctgaacctgggatgcctttgtgatggcagagaccaagagaaagtactgccacttgattacaaggtcaagctcccaaggacatacaaaaaagagggaaacctcatccagtatttttcagtgacttgcagcagagtttgtaactgtcgggtttgctgggctgtcttgaaaagtgggcttacaggtgtcctaagcctgtgttctatcctaagatttccttctccattatagaacacacacagaaagacacacaaggcacatcaaaattgctacagcttaggactagcctcataagttcttttttccaattaattaaaactttgtaggagataaaccgttaattttactgttcaaccagtttgcacagagaaaaagagagagagagtaggggggtgggcgaaagcgttgcctgaggcagggtggggaaggtgaggcactcagggagtccaaaaggctaagtgctcagggagtccaaagtggggagtccaaaaggtgaggcgctccaggagtccaaagacccacccattgcaacaacactgaaaacttcaggtggctgctgttgtgaagggatttttttcagcagtcccatcactcacaagtttctccttttgggggagcagaatatcccatgatcctgtacatgcctaatcctgtcacctatagccatcagcaaagattgcaaggcagattgatccaaagagaatagcagttaacgtcccagagtgccaaacccattcttagcacagagggactttactgagaggggcctctaaccctcctaagttgggtctctaacccaaggttggtcaagtttccttgtcttttttaagaggggcctttaacccactctgtcttaagagagactctaactcccctacgttgggcctctaacacaagcccatcctttaccctagtatatgcacctcgcttacccaaagtcagccaattggtgcgtgcaaatgattttcctttgggccaggggtctcttcagtatcgtcccttctgtgattcaccagaaagatgttaccataccccaccatttacccaaagttagactttgagtcaggagtttccacactgtggttgcttctgtggtcgccagagagatgttatagtactccaccacttactggggatttccacactgtagtcccttctgtggtcaccagaaagatgttacaggaaaggggtcctgatcctctcttggaactgatcctgagttccaagaaccctcacttggaactcacacaagaaagaattaggggcaagtccatagagtgaaagcaagtttattaagaaagtaaaggaataaaagaatggctcctccatagacagagcagccccaagggctgctgtttgctcatttttatggttatttcctgatgatatgctaaacaaggggtggattattcatgcttcccctttctagaccatatggggtaactttctgacattgctatggcatttgtaaactgtcatggtgctagtgagagtgtagcagtgaggacgaccagaggtcactcttgtggccatcttagttttggtggtgtaatgccggcttctttactgcaacctgcttatcagcaaggtctttatgacctatgtcttttgctggcctcctatctcatcctgtaagttagaatgccttaaccatctgggaatgcagcccaataggtctcagcctcattttacccagctcctattcaagatggagttgctctggttcacacgcctctgacacacacatcctcatgtagctagcaaaatgtaacgccgacctgctccttctaaattgtagacaagttgcttaattggaaataataacaaaaacacatctcacaatgctgaactttattaattgaatatttaagtgatacaaaaattacatattacagctctactttctgccactaattctgaaaacagccagctgacagtgacagaaacttagcaattgcaggcagctgacattctgaaaacaaacaatgcattttgtagtctttttccttagggataaaaaaatttaactcctgtcatccaaaagactaccagatggctaaatagtagaaaggggggttttattggtgatatcaatttgcaaactagggagagacagtctctgatgtgaactgaaggtgctctctcttcgaaaagggaaagggcaggttggcttttatgcctcacagggtctgtacatatatacatttatatatacatatatattttgtatatattacaaaatagtcatatatattaatcaggtttagtggaaaagctatacatgatatgaggagagttgagcacatgcacaaatggataaatgtataggtaacatacatcctgtgtttactttggggtgggattttagcattaaaatgaggtagaatttgattatttacatcagaaggtgaactataggacacaaagacagtttgtgcgcaattttataagctggtcaaaactgtcttgaggtctgcagttgcttatcaggagagaatgtttgtaaggtcctctgcccagtcagagttgtagtggcctgggttctaaattagttaggaagggtctgacaattggctgatagctcctgttgttaaggtgtttagcaagagtgtggtctttcttgtggccatagaaatttagcaagttgccacgccagcggagccctgaaccctatttccttaactttagggtctgtcttagttggcaaagagatgtctactttggtctctcagatcacattctatattaatgttctagtctagaagtgaacaaaattgaaagacaatttcaataagctagtaatgtgttattttaatgcatgcagtaaatccaaatttttgaatttgaacttgaagtggcccacaatgcttaccctatcccaattcaacaattcagtaaaggctaaataaatatttgaagattatctgtttaaatatgcatcaaattattagcctttcttcagtatcctcgtgttcatccgaactccatagattgttactaagattatattttatgcattaattattttagttcttacagtacctctttcagataacaaaataattgatacttaagtgaagccaagtcatttgctaacatcacacagttaggaggttccaatacccgtgtattaactcaggtattaactaggtgacttttgtcacctaggttgcctctaccactaccctctgggcctcttttgatgttcaaaatgactggttccacctaatactggtttctcctctaatccaattttctactttcctgagaaagtgttcatttctttggtgatacttagaccacaaccattgcctaccagtgtgtccactggtaatcccctgaagggaaaaatttcatctataggaaagaatggaatatctgatagagtcatagataagggacagaaagttctggcattgcttcaggcacaaaatctacttgcctttgagataaattttaccatctctttgatttggttccctgagccagtaacactcttcccattcttcctttttaaaagctggtttagattattgtcacttgggaatgaaagactctagagaaattctagagagtatagaggaatatggattctgaattccgtaattctgtcatcagacagacctgggctcagaatctagttccccagcttcctgtctatatgacattggcaaagtaacccttctttttatcatagttttattattttttaaatagagtaattcttggggaattatgaggattaaatgagataatgcagacaaaatgtttgacatacagcaagagttcactaaactttagatgttattaactaataaaggcactcaaagtaaattagcaaactctaaaaccgtgagtagaaaatttgaattatgaatgctagggatatctttgtacctatagttacataggtaaatccagccacttagctatacttactaaggtataatccctcctacaattttgtctgctcattcttcattttttaaccttctaaataagatgacaaattattattttagcaggtgaagaattacatttatatgatagcaaagaaatgacttaggataaagctaatagcatttaggagaaagctgttgagtttgcataatattatttcaaatgatgtcataaatgttaagaggaaggcattgtatgatcttaaagatactgttgtttttagactcagaaatagaaaaaaaaagaaggtaaaacataaaatagtaagtagatacatgtgacaatttgtagacttcttgagttgtcacaacaataatggcatcattttctattttatttaaatactaactgtaaaaattaaattgcattttctcagaaaaaaattttgttttcaattctgttcaatcctaggtgatagttcctccctatacttgaggatagggtctttaaaatgccctctggtgagctgggtgcagtggctcatgcctgtattctcagcactttgggaggccgaggcagatggatcacctgaggtcggagtttgagaccggactggctgacatggtgaaactgcctctactaaaaaacaaaacaaaacaaaaattagctgggtgtggtggctcacgcctgtaacccgacgtacttgggaggctgaggcaggagaatagcttgaaccctggaggcagaggttgcagtaagctgagataacaccactgcactccagcctgggagacagagtgagactccgtctcaaaaaataaaaataaaaaataaataaataccttctggttagaagaattttggttaaggatcttcatactcttttgaaaaatgtgctagagacaaaaatctggagtgacctgtatgtacatattctgtgtatttttacctccattaaaataaaacaatatagttggcacataaaatacagacaatagcaacaatattttacatatcttatatagcaaaaatagtaatctgaatatttatttactactatcccttactttcttaaaaataatttttagattctcagtactctttaatttgaatgagatgtttgtaatagtgtttgactttgctacagatatgcatactaaaatgtattttgtgaaaacaataaaagtacattttgtttcattttcctccatccaaatgtttcatggttttctagtgttgccttagaaaatgctgaattctgcctccatatccaaataggttttgattaatttcttccttttatactagctgagtcttgctttccttagtctcatcttatttgttttggttcctctaaaaggcatcttacctccatccttgtttgttgggaataggccccccaaaactggccataaacaaaatctctgcagcactgtgacatgttcatgatggccatgatgcccacactggaaggttgtgcgtttaccggaatgagggcaaggaacacctggcccacccagggcggaaaacagcttaaaggtgttcttaaaccacaaacaatagcatgagtgatctatgccttaaggacatgctcctgctgcagataactagccaaacccatcactttatttcggcccatccctttatttcccgtaagaaatgcttttagttaacctataatctatagaaacagtgcttatcactggcttgctgtcagtaaatacgtgggtaaatctctgttcgaggctctcagctctgaaggctgtgagacccctaatttcccactccacacctctatatttctgtgtgtgtatctttaattcctctagtactgctgggttagggtctccctgactgtcaggcctctgagcccaagctaagccatcatatcccctgtgacctgcacatatacatccagatggcctgaagcaactgaagatacacaaaagaagtgaaaatagccttaactgatgacattccaccattgtgatttgtttctgccccaccctaactgatcaatgtactttgtaatctcccccacccttaagaaggttctttgtaatctccccaactcttaagaaggttctttgtaattctccccacccttgagcatgtactttgtgagatccaccccctgcccacaaaacattgttcctaactccactgcctatcccaaaacctataagaactaatgataatcccaccaccctttgctgactcctttttcggactcagcccacctgcacccaggtgaaataaatagccttgttgctcacacaaaacctgtctggtggtctcttcacatggacacgtgagacaccgaccgagctggttttggtccttatagatactacaataatataattttgaggccaaggtttgctttgtttcacttttattaatctgtatcaagcctttgtggcaaaatcagtacttattatgcattattttactactttttcttttcccaggccataactatcttttcctaataactctccaaaaagagtaaaccatattttatatctggttgtgaaattcttaaggtatctctaaaggtatacacaagaaaaattttttatgaggagaatttataaataggaaaaattttcttcctttccccagggaaggcctcctataattgttaaaatttcatcaattcaatgttaaatggagtgttcagaaaataaatcaatgagttataatcacttgtagtaggataataatgtgttaactaatatattttaccagttaccctacctttctctcaacagctaagtattctgctttcattgcttcagaaaaggatagaaaaagtcaatttgactgaaagtacatatcaaccacttggggggaaaagaaactttgaaataataaaattttaaaaacattactttttcacctttgagtctctggacaagatatgtgtttctataacatagcctataaatatctattgaggatcagccatgtacagaacactatgctaagcagagaataagagatggattaagacatcatcatcatattaatgatgtttactgaatgcccactaagcttcagccattgccatgcatttttacatgtgatatttcatttaatatttactgcctgctccattaagacgtagaaaagattaaataaaaaatgtgtacgcctagtgcaatgaacttgcaatgatttatatatggcttgagaaaatcaaaaagttttcacagaggggtttgaaagcaaaatcttggcggagtggagagtggtgactttgatgatagggtgttggatgaagaaaaaggtataagtaggaagaggacagaaagccaacactgaaaaaagcaaggaactagaaaatgaaacagtgatgcacagctagagagaaggtgaggaatagagagaagtaaacccggaaacactggctacacttgatgatggagggtctcatattccagtttatgacttgcaggcatctagtgcatattctgcgtggctcgctgtgcaaggactggggtggctttcttttccttacatctaatatagagacagtggaaactaatatagcaattcttccatccagaaaagttctcttgtgctccacagagcatgcttatagggttcttctgtgttctgagtgcttagtgggtacgagctatgaacaggagcaaactttttgaaaagagaaaaaaagcctttgtttctttaataaatgagtttacaattagaagattatgtaaactgtgtttttttttcttttttccatactttgttttttttgcaagggctattttattttttatgtatttttatattttgtagatacaaggtctcactaggttgcccaggctggtctcaaactcctggcctccagcgatcctcctgccttagcctcacaaactgctgggattacaggcagtagccacagtgcctggcctcaataatttttttgaactttgtatatttcacacattattgattaaattgtttaactttttcaattttgttgcttgtgttccagagatatttaattccctttaaatgcctatatgatgctaaaatggataaaagtgttatactgaatgccagaatgtaaaaatttaggagtttctcccatcattttttttcaggttatttaaatttaatttacttttttttcctgacttcttttaattaagaagaggaggaaaggagggaattttccatgagtttgaatcctacaaatgccacaaacagcttctgaagctgaagccatgacaatgaacttccatgacacaaagaagatgaggaattggaagggaacagtgcaggagaaacacagtgacattgtgtcacagtaggtatttatgcctgctatcctcatccgagataaggtcaataacttctgctggtgaagcccaagtctgctgggggctcacagcagttccatgactgtgtctgcctggtgctaagatactgtgtgcccgagccatgcttccacgaagaagcactccaaatcacaccacctcgaggatgaacacaccttgcatgttcctgaactcccacaatctctacttcactatctgaagaggcaatattaatttcttcattgagcggtgcattgccggcagatattttgtcacttgctaggaatcctggatgcaaatgacctgcctctgcattcagctcctctagaagccagctggtcctccaggtagctcctgtgtcctggccgcctatagaattattgtgctcttgaactactgcagccgccgataaattgtacacagttaccacttccgggtcagagctggtgtcagacatatcataatgagctacaactggaggtccatctggtatctctgcagtgattgtcttgctgctccctgaaacctcttcatcatcatctgatgagctcgtgcttgtcacaagtcaggtcactgtcactggtactacttactgtcctgcagcaggttgtactgcttgcagcaacctcccgttcgtgcctcagtagcctgatcctctccttgtgcttttggctccaatgacctttaacccattctgtttatcactggattgccagtttttcttggcagccatagtggatgtttcacttttagatcgggacctcctagacttgcgcccaactgtggcaccagacactcctgaagggtctccttctaccgctgtttctgcctgagagggttcattctcttctgcggaagacaacgtgtctgaatcagccaggtgatcactagaagaagggcaaagcatgcagtgattagaggagtcactctcataaacttggccagttgtaggcttgtcactctctgtggatgctgagactcagaagagtctcttctcagctccatcaacaagcagggcattgaagaaagaactgcagaatctgctacaccgtctttctgaacttgagattccagttctacagattcatcttcctccttcgctgtctcttgttcagatgtttttggtgggacttcagactcaatgagttattcgagttttcccactgcctcctctatctttgtttcagaatttcaagttaaatcatggagcagcctctaggaaatggtatcaaagatgcaacaggaaagcaaacaaaaaaacttgtaggccaagcctgggagatcagaactcagaggattgggtgccacttccttattcttacttggatctagaattcaaatttacattgtccacgtggtcaagaaaccctgcgctctgcagtgactccgtgcctcctggctcgctcagcgcaccccatcagggcacacaccatcccccaaacttaatttgaattttaaattagtattctccttatttcagtttttggcttctgtaagagaatacatcataatttattgcttcagtctgcaatttgccatatctcctaatgacattcagtagtgaattgttaaaaagaatctgtgtatctacatattgattatgattatctatctatctatttatcacaattctggaggctgtaagtctgagatcaaggcggcatcagggttggtttcttctgaagtctctctccttagtttatagatggccattttcattctgtgtcttcacgttgtctttttgctgtgtgtgtctgtgtcctaatcacttcttataaatacaccagccatattggattagggcctacatgaatcacctccattttaccttagaaacatctttaaagactatctccaaatatagtcacatactgaggcactgtgggttagatttcaacacatgaattctgagggaagacataatccagctcctaacaccaccaaagtgtatagttttatccattatggagtctcatgtattatgctttgtgaactctcttttttttttcattttaataaagtttccatttctaggatgctttgtgagttcttgagtaggcaccatgccttgcattattttgagtctcccatttttggggggtagataccggtttggaagatatgggtcttccatcaaaggagacatttgcattgaaaaaatcagataaatgacagactaattaataatttctaattgattattaattaaagttaaggaaatgtgtttgaaagatagatcccaatatatgagtacattacaagaaaattcaataagaagccgactgagtgtgaacaacatagagatatggtcatccttggagaagagttttttattagcatgaacattgtatgtgtttatatctaggaaaaaaagaaaatggacttattcttattaatactaagatatttctcagactaaataagacaatataatggttgagccaaattaattgtgttagaacctcaatcgatattccttgatcatgtaggatgttggagatatgtgcatgactctaaaatgctatcaggtagactgcctactggaaaaattcccagtgggcaacaatactgggggaaaagtaggttagagtaatgtagttgatagtaatttgatggcaagttgtctaccgtagcctaaaaagagtttgaaaaggaaatataataataataaataataataacaaaatatttagatcagatatttagattctagagtgaagaggttttaccagtaggcagatttctgcatatgtaattttactgaagaagtggctttcaaacctttgacaatttctattgggaccaggtaacgcatgtacacacacagacacacacaaggacactatttacctttctcatgtatgatgcactctaacattctccattttattcagttttgtctcactgcagtctatttcattactgtttctgatacattctatgtatttcataccacaccgaggctgcacccaggagcttgagaatcactgcatttgaaagccttttctaacaaagggtatgaagacttggaaaggtgtataagtgtccagcatatggtgtgccatatctgcctccctggagatgcccaatgtatatgagacagtcagtggaggctaagaatctgacttccagagaggcatcattacactgagatccacaaagcagtgcgaagggtcaaaaatgaaagggaactagaaccaagatagaaaggttatcagggaaatgaagcattgtacagaagagctggtgttagacagcatgaagaggaggataacaagtataaggagtaacactatcatattgttgtgtttaggagagtcaaccctgatgttagacatgttgtactcaaatctcacctttgatacttacacatttgtcactttgtataagcatctaatcattctatgccccatttaacaatctataaaatagtatctatgatttattgagcacttaacaaatgcaaggcactacagaaagtgctttccttttgttaactcatttaatattgacaccaccttaatgaggtaggcacagattttattcctagcatacttgtattttagagttgttttgaagaggataaaataacatgaaacagttcccagcactacacattcatgaaatcaaaacagtgagatgtaacgattttctgatgtcctgaacaaaaaatcaaaggaaacccatgaaattactaagtgtcacgcaacttaatatctatgtcatgagataactgcattagtttgcttatctagaaaggggcatgaaatatgataagtaaagagaaagtgagttgatggatataaaacacttattgttgggagacaattcagggcctttctgcatgtcttgtattaacttttgttctggactatctttttaatgatgtttgtataggaaacagccttggaagacagagataatgtctcccatcagggcagaggtcaggaatattgtctttattaagatgatatcgccctctaggacaaaggttaggcaagtttgctagcaaccctctttaaaacattggagttttctaaacttggtgttccttagttgtgatacaaaccgactctatgagcagcacttatgtgagtataatgtccctggagatcccggtaggtaaagaatagatgcagacttggggctcatgcttcctgctctgctataaataataaagtccttcatctgtgaccctgaagtctattcttttctgccagcatctataaaacaatggtaggctaactggttaaaaaataatactctcagacttttcataattcttgatacttagataatgcctggctatataaaaagtacacaataaatggaaacctgttggcattatgatatctatcaatttgacaatgcgtcagataataaatttaataaagcaactatacagtgcatgtctgctacatgctagtcatgatgtgaggtgctaaggctaaaaagctgaataagacagattctctgatttcatactctggagggggagatattggcacataaataattataacttgtcttaatattatggtagaaatattataaggacctagagcattaaggaggcgacatctatctctgcctaaaatgtgagatggagaggaggtatgagggaagttgcttaaggggaagtaatacttcaactaagttttaacagctgacagttagtgtgaatttgttagtcacatgtcaactataatttgttgttttaaaattattggtgtcagttaccatttatggtaggttgagttgtgtccccagaaacatgttgaagtcccaattcctggtacctatgaagatgaccctatttggaaataaggtctttgcagatgtacctaaaatgtaatttaagataagcttatgctgaaacagggtgggcccttaatccaatatgactgatggttttataagaagaggagagacaattatgaagatatatgcatggatatgttcattgcaatactattcacaatagcaaagacatggaatcaacccaaatacccatcaatgatagactggataaagaaaatgtggcacatatacaccatggaatactatgcagccataaaaaggaacaaaatcatgtcctttgcctggacacgaatggagctggaagccatcatcctcagcaaactaacgcaggagaagaaaaccaaacactgcacattatcacttataaatgggagctgaacaatgtgaacacatggacacagggatgggaataacacacactggggcctgttggggtggcagtaggggagggagagcatcaggaaaaacagctaatatatgctgggcttaatacctaggtgataggttgataggtgcagcaaaccaccatggcacacgtttacctatgtaacaaacctgtatatcctgtatacgtatcccagaacttaaaaaaataaaaaagaagaagaaatgcatggaaacacaaagacacacagaaggaagatggcactgtgatcacagaggcaacaattatacaaatgcaaatcaaagaatccccaggattgctggcaaagtccagaagcaggcagagagatggcatgcctctgccaacaccttgattttggacttttaacctccagaactgagagataaaatttcttttgttttatgtcacccagtttgttacagaagccctaggaaaaacataccatttcattattgttttccatatacttatcttcagacaaaaataaggaaagggcactgtggtcaaaaacaaaagaaatatgagagagaataataaattaaaaaaacataaattgctaaaagtcactgtatggggaggaaaacggcagctgatgaggctggaaagtaatagatggaccctagtgtagtgtaatgagtgtggcttttggatgtaacagacctgtgttcaaatgccagcttctctatttactagatgtacgatctcagaaaatttaaccaccctctctaaatttggtattattgtccgtagaataagataacaattactactttgaggggctatttggagaatttgggaaatgtggataaagctcatagcaagtatttgatacatgctagtcagtagtagcacttttagatttacattagggagattcttctgacagctgtgttgatgatggaaatggagtgggccactgccgaagtgtgggtggctggagcatggctggaagaatagataccaatgaggcagtttttgcatcagccaagatgagagatgttagaggcctgagctatatcaatgccatagtggggatacaaatgagaaaatgagtgagaaaagtgtttctttgttaaaattaatttgtcattattgaccaactcaatggaagtcgtgatgagacagcagtagtctttaaaccagccactcctacccattccttctaatttatgaaaaagagaactgatttcaggtgttttgttttgttttaattcttccagttaaggacttctattctctcactcagagaagcaggttgatgtatggaaactatctcttaagaagggcctatgctaaaatgtggctggagaaattgatcagagtgaagaaaagacttggtcattgcacatgaagaatggcagaaaaattgaaagtcctttttcacagctaaaaagaaatcaaaattaggtatcatcaattcaatattaattcaactcactatgaaaaaaacagtaagttggattactcaaatgtggtgacattgggatttgactacataaagaattgaattagaatcaccttcaaattttactcataccatagagttcttgatttcagtttaatagaactatacaaaaacattatattctgcttttagaaaaccacacaatacaaggaactcccacccaagccctaaacctaaacaaacagaaacacaggaaaactgtgcttgaagtggtaagttatttctgcaacaaagaaaagtagcagaaaatgtattcccttgcaaaaatattaaatagattttaacaatttatagattcagacacgcataataagaaatagaatttgaaatccctgtataaattttatgagtcagaacatttccctttagaagcttatatttatcacataaaagtaccttcacacacacaaccacctactcacctgcccaaacacacatgcatacacactcatactcattcatatattaaatatagaaaacaaagatttgagacagaataaataggtttatatgtgtgactgtttgataagaaaattaaacactagatgcttgaaacgcctgtaagaaaagaaaactctgaaatgacaagtagcaaaattaatttgtaacaactaaacaatgaatgtgaagtttaccagttggaaaggacagatttctaagaacacagagaagaaagtcctctcctaaaggacttttcttattccaaggcttattggaaaaactctcaggtgaaataaacatcattacaatatgatagatgacactggttatcttttggaatcagagatgttaatgaccattctgttgattttcatgttcatgatacagtccttatgaatacatgtagcataatttctaggtacatgtgttttcaaccccaaccattccagtttaggaaatagtcttcaaatgtagctgaacaaaaactgtatatgcaacaattgttttcctggtgccacctgtggatttctcttcacatctaggattctttttattggatagtgttcgtggcaaccaaactttgccctttaaagatgaatttgactttttaaacaactgtgtcaataagattcatgtctgttgaataaggttaatggttaagtaccaaaattaaacaagattttattatagagcaaaaacgcgaaaaccaaaaatcccaaactcatttatttctcatattcatgtggctgattctgaagatttatcactcaggaggcagcattaaggtaatacattttgcacatccaaatatagattacattcaaagcatatgaacaaagaaaaataatgttttggaaattgtgataaattttccttagaaaaagatgtttaaaaaattgatatttgggaaacctaccgtaatttgtatatgatagcattcatctttttcttttagaaaaagggaaaatgtgtttttagcttctgtacctgattatcacatttgtatgtactaggaatgctaaatataaattacaagggtcaatggttactgtccatttgtcactgagggtcagttggctttgatcccctccagtcgatctctccagggagcctgagccttcaccctcagttattgttgtggccctgtgaggaccatgccccactccattcttcatggcttctttccaacataatgagtctaaaatcattatagtaatagagattaattggaatagattccttgaatatttgcacttgtgctctcttgtaagggaagggtcttcatcacacagcaagggctggattttctaaggtagcagggctttgttccctagtcatgattgctaacagtattaccaagaatgattccacctattttggttggctgattttaaatataggaaacagttgacaagagagttatgcagtctggagaacagaggcaaaacctacagttctaactttagttttgtcttaaatttgacatttctgactactttccaggatcaagctgagtgatggcagaacacaggcaaaacaactctgtgtgtttcactatgctgagcctgggtgtggagataacaccaagatgcaagagggccagacagtggctcatgtctataatcccagctttttagaaggctaagatgggagcatcacttgaggccaggagtttgaggctagccagggctacgtagtcagaccctgtctccacaaaaaaaaaaaataaaaaaattagctgggcatagtagcacatgcctgtagtcccagctactggggaggctggagaggcaggatcatttgagctcaggaggttgaggctgcagtgatctatgattgcaccactgtacttcagcctgggcaacagagtgagatcctgtctcaaaaaaaaaaaaaaaaagatgaaagacatttcatatggaccaagaaaaatgagtgatgtttaaattttctaacttttgattgattgagaatttatgtatttctgtaaaaccaacatatgtattaagctggagaacagaaataatttactcaattgcttttttattgcatcataaatctattcgatgaaaacttacaatgtactgttttgttttcagttctttggagaaaaggcatatagattttattaacacatacacaggggaaccacagagtgtttatccccttactgttttttaatacattatactgtattattttatcaagaattaccaatgaacatacaaaaatggctgtttggagaattgaaaggaattcttttgtgagaatataacttaaattctagaccctcaagcaaaacttgaattaagtttcttatttctagtatttgatttgttgttataactattgttgataagtgtaacaataacctgcctatatacaatcatagtgattaacaatttaactataaaggccgggcgcatggctcacgcgtgtaatcccagcactttgggaggctgaggcgggtggatcacgaggtcaggagatcaagaccatcctggctaacatggtgaaaccccatctctactaaaaatacaaaaaaattagccgggtgtggtgtaacaaaaaaattagccgggcaactgtaatcccagctactcaggaggctgaggcaggagaatggtgtgaacctggaaggcggagcttgcagtgagccgagatcacaccactgcgctccagcctgggcgacagaatgagactgcgtctcaaaaaaaaaaaaaaaaaaaagaaaaaaaacagaaaccaaaaaaacaatttaactataagtgcacagtggtattattataaaggttaagagcttggattttagaatcaagtagactcatgttcacatatgttctttatactcaccgtatgacaaaacacaattatgtgaccttcataagccttcgttttctcacctatatctgcaacattaaaacctactgaaatggctccattgtctggggaaacacccagggtcctttgtctcgcaccaagaaaattagtgacactgacacacacatggagtggattaaggagcagaaagtttaatatgcaagaaggaagagaacagctccctggcacagagggaggagggctccaaacagaataacacaccttgcgcaggaggacaggtagggggttgggggggcagtaaggggcaggggggagcagttggttatattgagaggcttgaggaggtggtgtctgattgcatagagcccaaacagggcaaacgggattgatttgaccaggtgtgtcattcacatagcaaaaagactggccctccaagcctaaccttttattatacaaatgaggcttctacctggctgtgccatgacacctgcacatgtggggacaaagaaaagggagcaggaggctgggcgcagtagctcatgcctgtaatcccagcactttggtaggccgaggtgggcggatcacctgaggtcaggagttcgagaccagcctggccaacatggcaaaatcccatctcaactaaaaatacaaaaattagccgggcgtggtggtgtgcacctacaattccagctactcaggaggctgaggcaggagaatcgcttgaacccaggaggtggaggttgcagtaagccaagattgcaccactgcattccagcctgggcgacaagagcgaaactctgaaagaaaaaaaaaaaagaagaagaaagaaaggaggagagggaaggggaggggaggggggaggggaggggaggggaggggagggaagggaagggaagggaagggagcaggaatcaccacattgggtggacctgactcttgacagcctgcatttacgtatgcaagcctgtggcttgcaaatcaatgcttgcaagtctgttttttttccagccgctttctgttagaaatgtttttattaaaagaaaaagccttactgaggactctttgactcttttaccctttctagctgcctgaaataatattttttttttttttttttgaggcagggtcttgctctgtcacctaagctgcagtgcagtggatctcggctcactgcaacctccacctcctgggttcaagcaattctcctgcctcagcctcctgagtagctgggattacaggtgcatgccaccatccccagctaatttttgcatttttttagtagagacggggtttcgccacgttggccaggctggggtcgaactcctgacctcaggtgatctgaccatcttggtctcccaaagtactgggattacaggcgtgagccactgcgcctggtcaaataatttcttaataactcccgtaatactacttcatagcttgcttttacaattagatgagatgttagtaccgtacttggcacagcatctggaacatagttcttcataaataaaaatgattattgtttctatgttattctgtagccaactagttacagcagattttttatgccattgtacattttctttcagttttctatttttccttttcatgtatcctactttagagttagcatcttatttttctgaaataaaaaatgtgtatttctttttactttgtttatgtattaactgtgtattagcaataccaatcaactttgactgcctgaaatttgttaaaatgatattgtattgctaacaaaatgagtgactattaaaaaaggaagagtgatatgggaatcacagaaacacagtcacagttaaaatcatgtatggcagaaatgggcaagaaggactttgatgataacacttttgaagacttgtacagcttttacttctgatgttgctggcacagaatagtaacatcatatttgctattgttgccacaaacacctataggaattacgtgttggtcacattccacttgaatgaaatctcttcaaattatgtttgagtctctagcttctgtgtaatatgcatcttattggctgagacgttagaggccggaaaagcaactgtgtattatttcaggtccgatagtttggggtaggctctgctctctagcaagactcatatgatagggcattttcaaactgcagcaaaaataattcaaatgctgggtagccaaaaattgactagtgcccactacaaacaataagttttaaaatgagctatacaaagttttaaattatgcttaaaataagttttaaagaaattgatgactgccatggatggaggaatatttcaatttaaataatccatctctacaatttacttttttaggagaaatccgaatcagaatatttgtaccaaattagttacaaggaaatattgattattaattatgcctgataacattatgaatactgtagctattaaattaaaatcttattcaaatagaaattataccgattgtgtatagtcctgttctgacaattgaagcagaggaaaacttcctaactcagcctatgaggccagcataccctaatgcgtaaaaccagacacacattacaagaaaagaaaaaaacagataaatatctcacatgaacatagatgtaataatccttaacacagtattagcaaatcaaatccaaccatgcgtaaaaagcataataaaccacaaccaggtgggatttatctcagatgttcaagattggttcaacatttgaaaagcaattaatgtaatccattaatacattaataggctaatggagaaaaattacgtgatcatatcaatagatgcggaaaaaggacttgacaaaatcaaactaattcatataaaagctctctgtaaactagtaatagagttgaactttcttaattcaataaagaatatttaccaaaaacattatacttaatggttatcatcctaattcatggtgagaaagtcaatactttcccactaagatcaggaacaagtcaaggatgtcccctctcacaattgctttttagtttcattatggcagctctaacttatgcaataagataaaaataaataaaagatatacagattgtaaagaaaaaaaaaactgcctttgttcacagatgtcatgagtatgtagaaaatccaaaagaatcaaccaagaaatttctggaactaataagtgattatagcaaaattgcagaatacaaagttaatatacaaaagtccattgctttcctatacatgactaatgaacaagtaaaatttgaaattaaaaacacaatatcaattatattagcacctcttacccccaaaaagaaatacagtcatctcttggtatctgtccatgggagaatggtttcaggtccctctgtgggtaccaaaattcatggatgctcaagtcccttatataatctacatatattttaccatatactttaaaacatctctagattatttataagacatagtatgatgtaaatgctacttaaatggttgttatattatttacatttttagtgtttaattactcttttatgtatttattttttctgactagtttccttagttgtttgaatctgtggatgcagaattgcagatacagggagccaactgtacttaggtataaatctaacaaaatatgtatataatctatacatggaaattataaaacttggtgaaagaaatcaaagaactaagtaaatggagagatattccatgtttatggctacagactcaatattgtcaagatattagctcttcccaactcaatctataggtttaatgccatcccaaccaaaattctagcaggttattttgtggaaattgacaactaattctgaaatttatatggagaggaaaaagatcaagaatggccaacacaatattggaaaacaaagttggaggacagatgctacccaaaataccttatgccttactttaaggttacagtaataaacacagtctagaaccagctaagtaacagacaaacagatcaatggaacagaatgaaaactcagaaagactccccaaaatataatcaactgttcttcaaccttggcgttgctgatgacttttaaggtataataccaatggcactatccatttttaaaaaatggataagctggatttcattaaaattaaaaaccctgcactgtcaagaaaatcaaaagataagcctgggactgggagaaaaatatttgcaaaagacatttctgataaaggactattatccaaaatatgtaaagaactcttaaaactcaacaaaaagaaaacaacccaattaaaatataggtcagagtttttaacagacttatagatgtatatacatttgaaaagatgctccacattatgatatatcatcaggaaatgtacattaaaacaacactgagatattactacatacacgttaaaatggccaaaatatgacaataacaaatgctggcaaagatgtgtagcaacaggaactctcattcactgctggtgcaaacgcagaattctatagacattttgatttgacagctaggcaatttattatttaaaaaaatactcttaccatatgattcagcaatcacattccttggtatttacccacaaaagctgaaaatgtatgtccacacaaaaacttgcatatggatctttatagcagctatatttgcaattactaaaactttaaaacaaccaaaatgtccttcagtaggtgagtagataaactgtgatatatccagtttataatggaatattattcaatgctataaaagaaattagctatcgccgggcatggtggctcatgcttgtaatcccagcactttgggaggccgaggtgggtagatcatgaagtcaggagttcaagaccagcctggccaacacagtgaaaccccatctctactaaaaatacaaaaattagctgggcatggtgctgtgagcctgtaatcccagctactcaggaggctgaagcaggagaatcgcttgaacccgggaggcagaggttgcagtgagccgagatggtgccattgcactccaacctggcgacagagctagactccgtctcaaaaaaaaaaaagaaagaaaaagaaaaagaaaacagaaaagaaattaactattaagccatgaaaagaaatagaggaaacttaaatacatattactaaatgaaagaagccagtctgtaaaggctacttaatgtgtgattccaactatatgacattctggaaaaggcaaagctatgcaaactgtaaaaagatcaatcattgctagggattaaggggaagagaagaataaaaaagtgaaacacagaggatttttagggaagttaaattcctctgtatgatactataacagtgtatacatgtcataaatttgtccaaacccatacaacaccaagggcaaaccttgatgtaaactatgaactttggatgatagtgaaatgccaatgtagtttgattaactgtaacaattgcaccactttggtgagagatgttgataataggaggtgaggtgggctattcatgtgttggaccagcctgtatatgaaaaatctctgtaccctttgcttgattttgttgtggacctaaaactgctctaaaacataaaatctattttaaaaatctaattaaatgattaaaataatacatttccttgaagaagttttgattaatcaagttgtgctggtgaaaggttcataaaaataacaataacgtcacattttttgtccttcatttatcataatgcttaaagttggatgaagtctctgaaaagaggagcaatactaacacttagaatttattttgttctttatggttgtgaagatttttgcatccatttttttcttctgatttatcaagctacattctgaggcacagggaacaggagatagtttttagcatttctatttcatagacatagagcagaaacccacaatttcttcttttggcttggagtaaattaattttctttttgctatttttacctttggttgaggtcagacaaaagtttaattaatctcaaaaattttcttaacatcagtctatccagagtgcttagagaaagctgtaggatatgaacttatgtaagtcaatttatatttgttgacatctcagttaagaagatgtatggatgagaggaaaaatgaagttatttttaaaaatgagcttgagtttcatatttttaagtggcccccaccatcttgcattaccctggatcattagatatacatatgatttttttctttttatattagtggagttgggttggctgaagagtaccatcttctaaggtctagaatgctcctgactaaacctcagagaagagcaatgcagatttgattgactttcacctgttatctttcctacaattactttgatactcaactatggcttgtattttgttgacagacattctagaaagctttgctttctgtgcatttgtttaatccaccatttactatatagaaaactcaaatgaacttaaatagtttgaagtgaaaaaagctactgtatggaggagtaagtccctaaagtgaagaccttgctttgaatgtcaatgattggattttctgtttcattttccctgtatctctcaggatgaaacttgaaacagttagaaccatgaagcagaagtatcataaaagaccatttattcttcaaactcaattaacatttacatttttaaagaattatctgttgtactaccctcacctcagttttcaatctgtgtaatggcatggtcagataaatgtggatgatgctgtctttttatggatgaaactctgtatgtgtgcacgtgtgtatgtgtatggtttacaagccttcttatttatgttctctcaatcacttgtctgaatcctaaagtgttgagttgccacagatttcttctatttagttgttttgtgctgccgtcctttaagaaataggcttttttttcccattacggaacaaactgccaatgacgttgagatattgatcgaatgaaagaactattaatataacttttatcttgggatatccaaaggtcctcttcttggaagataaataatttaaaccactttcactattctttcagagtcagcactcttcttttaaaaggaaattttcctatgacattttagattttcatgtaatttttagtgacctttgaagtcgttgcttctttaagttaaatgaataaatagaattaagtatattctatatacatacacatcaacttaattgtgggaaccatggtggtagagctcttttcggaggattgttataaaatatttacacagaccgggtgcggtggctcatgcctgtaattccagcactttggaaggctgaggcgggtggatcatttgaggtcaggagttcaagaccagcctggccaacatggtgaaaccccatctctactaaaaatacaaaaagttatccggatggtagtggcacgcgcctgtaatctcagctacttgggaggctgaggcaggagaatcgcttgagcctgagaggcagggttgtggtgagccgagatcacgccactgcactccagtttggttgacagagtgagactctatctccacaaaaaaaaaaaaaaaaaaaagacagatacttctttaataaaaaaaaaattgaaaagggttattctcaaatgagaatatgtcttaactattcaacacaaagtaattagatcaaaagataggggctcaccaagagtatgatgggattttttaatttattagatggccaggctgacacaaatatattaaaaattgtagggtagagaattttgaatataaaagagtcacacaacagccattttagattccagagtttagcattgagcccagacatccagttgtataaagtagatgacataaacaactacaaaaacaacaacaaaatagcaactggtacccttatttgaaaagccaaactggagaaatagataggattttttaaaaaatcacactatgcttacttgccttgccaaattaagtgattggaggaaaactatcaggtcacactgaaagagcaaatgctagtcttacatagatttgtccctactgcattttctctcatctggtatttttcattcttactcaaaactcatttgttgtgtttttgatgacaaagtttgcatcagcatttttattcttagaagagaaattctaaaaatagtttgttgttccatagtctcaaatgtataaaccaggatatttcctttcactaaacaagtgggggagtgagtgcaattcatcgtatcagtacataataattaataaggtctcttaagccccagtgaaatatacttgaaataaaccctaaaatttaaaatactttagaactttccatcctttattatttttaaaatcagaagtcaaaacttgtcattgagtacctaaagtatgtacaaggaactgtgtctgatctcaagtgcgggcttagagacatggttctgtcactctaggtaggaaaatgggatatgcaattacttcaagtaaataaataattaaattatgacaagtttaatgtttaaaactagatttttcaggccaggtgcagtggcacatgcctgtaaacccagcactttgggaggccaaggcgggcagatcactaggtcaggagctcgagaccagcctgaccaacatagtgaaaccccatctctagtgaaaatacaaaaaaattagccagacgtggtggcatgcgcctgtaatcccagctactcaggaggctgaggcaggagaatcgcttgaacccgggaggtggaggttgcagtgagccaagatcacgccactgcactccagcctgggcgacagagcgagactccatctcaaacaaacaaacaaacacctagattttcagtagaccacaggagtatagaacaggaaaacccatcctagcccctggcctgggagttcaggaagtgttttccccttagaaagtgatgttgagtcatgaagtgtagcacctacctaggagtagcacttacttacacaaggagaaaagagtgttctgggcagaagtgtgtgcaaaggctttgagaggacaaacagtccaatagtagtgagtaaatgagaaaagctcaggagagctggcatggaaagaacatagagtgtcctctgaaaagactcagtaacatgaagcattgcattatgtaggcccttgtagattatagtaaggactttggaagagtcaggtgagagaggattgactatgctgatggtggtgaaaataaagagaaatagacaactgatacatttgtaaggcggatcaacagaaagggattggatgtggatgacagcaagtatatgaggaattgggaggggtccaaacgattccaagagcagtagttgatggcgtcagtatcagagaccaggaaaccagagaaaaatcaagtttgcagatggagatcaaaagttaaaaagtttggatttatttatttttgtgtctctgagacacatcaattaagtcattaaatataagaatttgtagattaaaatggagaaatagatttgagagtcctcatcaacaatatagtatattagtcaaggtttagtttaagctgatacaatgaaaaaaattccaaacacaatggtttaaacaagacagaaaacatttctatcttctttggcaatacagaagaaggtggtacagggctggccaggcaagtctgttaatttcaactcaaggttttatctctgggcaaagttttattacagtggctactccagcctgtgccatcatgaatggatttcagcctaaatgaaagggaaatgaagaggttgcttctttccttttaaggatgttggaacctagacatgtcacttacgctcacttagcttaggcaagaaaagtactccctgtgtttagtaacatagaattccctagcaacctaagttacagcagattgaagggcatttactgtgagcagaaatggcaagcctttttgagaaaaattgtcatgaagatgtggagagtgggacagaagctggaggatgataaagatgaagagagaggattttgatgtaattaagttcttataatataaatgataaatggatacattatgaagacattgagaaaaaggggatacttgatggtggagtaactctgtctagacaagaattcagagaatattcagagaatattttcatcctgcagaatgataggaaaggatggagacaggtgcaaaaatatttgtggacttggtggcagaattttgatgtagttccatttgctgttttctatctgtcataaaaagaaggtaaggccgggtgtggtggctcatgcctgtaatccgagcactttgggaggccaaggcaggtgaatcacttgaggtcaggagtttgagatcagcctggccaagatggtgaaaccccttttctaccaaaatacaaaaaaattagctgggagtggtggcgtgcacctgcagttccagctactctggaggctgaggaaggagagtcacttgaacacgggaggcggagtgaaccgagatagcgccactgcactccagccgacaaaggaagacttcgtctcaaaaaaaaaaaaaaaaaaaaaagaggaaggtaaagttatctgctgctgaaaatgactgaagagatggcaccagtgctcagactgcagaggagagcggaggggatttgaaaacatcatggaaggcagggcagccacgcacagatgagcaggctgtgcccgctgacctctaggggttgccattcaagcaagttttcatgagaacagtgctccctagcattctaggctaaataatcacaaggttcagtggaggcattgacatttgcagagtgtactagtggaaaactgactagagagagacttacgttactgtgaaacctaagggccatttgtagttgtcagcctgaatttgtgatatatcagctagtctatcattcattagtaattaaattgcattcctactctccactctctgaaccacatttgacttctaaaactttatcatttcatcagttatctaatttattttcagctgtttattttgcttattctatgtcatttgataaacttgttcaagaagattctactttttccttagccagtcttaagtttctttcccatttttcttcacttttatttatttttgtattatacattcatttaaaccttagttccattttttatggagagatgggagtttagctatgatgcctaggctggtctctaactcctggcctcaagcaatcctcccacctcagcctcctaaagtgaagggattacaggcatgagcggttacacccaaactaaaccttagtttcttaagggaagcaatatcttaatcttatgaacttttgttctctcatgctttccttatgtatctttcttcagtttttaaatgctcatttattttaatggcaatccatcctcttttatgctatttggtttatacagttattgttttgtctgtcttatgcattatatctttcaaaatcatctcacttttaaatttatgtttaatgtattaaatcaggaaaatagatgcaacaaaaggggccagctctgattaatgatgggtgctatgaacaaaaagatgagaaatgtggcacacatgcccagaattcttattgacttagtttatgataaacaacaataaaaatgtgcaccactaacaaccaaattgagagtttggtcctctgaaatataatcctggttttacttctatccagggactctgcagtaacttgagtagggcagaagttctgcacagcttttgaagtccaagaaatggaaaccagttgttttcaaaagtgtaataattctactgcttactttattcttacatcacagtggttgtccctgataaaaggttagcaggcagtaccaagacttgctagctcacaaaaagtcaattcagatatctgagtttaatgcactttatgaaatcctccatgtggctgatctctgactattcttctagaaaagcaatgtccttgtagggagtatgacctgattactaaaaatactgacatttattatccctctttcccataactcaatcaataagggaacagtggaaatgcatggttcagataaatgtaggtgctcgcagatttggtctttaaacttttaatcaaaatgtcaagaatccaaaatgtaaataactcaacatgtaaatgagtctttcaggctcaatatagtaatggatttggttatgggaaaaaaaaaaaaaaactctagtagtaataaacgtactccaacaggtctagaaaatggttctaaatgaaatagtctaatgaagactttttttgtgttaagccatttcctagcataagcaaacgaactctagatttgatttttatgtagatgaatacatcttcatgaaaaatatgtggactttatatgcagtcctgatattggtctttttgtagagttaaaaagtgctgtgttaagtagaatcacaattagcttcttcattttcataattaaatatcagcgatgatgaagcattcctgatatttagaataatagattttattcagtcaataacaaggaaacaaggaactttagatataattttcttttcttttttttttttttttttttttttagagacaaaatctcacttcgccgcccagactggagtgcaatggtgcagtagtaactcattatagccttggactcttgggctcaagcgatcttccctccttagcctccagagtagctaggactacaggtgcacaccaccatgcctgactgatttttaatacaatttctgtagagacaatgtcttgctttgttgttcaggctgttcttgaactcctggccacaagcaatccttctacttcagcctcccagtgtgctgggattataggcatgagccaccatatctggcccataattttcatattagcaattagctacatttactaacctggctgagataattgagcatcactcaagaagcaatctaagatagcagttttcaaattatgcccctggagaagtccaggatttctccagagatgcaagtttacatttagaagctttctaggtgggtgtggaaacatcactaactcctatcttttgcaagaaagagagccctgttttaatatctttcgactactttctcctgcatagcatttatttggagaacatgtttctcaaacaaaaatgaggtttacaaatcactgctataaggatcttaggaaatattcttttctgtagattctttgaactcagtccctgtatcatgttagatgaatagggaacactcatttagccatacacataaatgtcttaccaacccccttccctagatttaaagttagattctaattactgttgactaagtaaagtaatcccttctgcctttccacagttactgatttagggatggtgatatgtctccccctgccaccacttggagaataagataaaaaggcagctttatgaaggtttcttggaagggaagtcaatcactcttctggagggtgaaagaatccaactctagatgtcaacaagaaagcatctcatcataattccaactggcagacgttctcagaaaatgaagactgaatttagaatgcagccagcataaaggatgattgaactaacaatggaaagaactgaagaactttattacattgttgagctctgggtcaataaaccataaagcctgatctccctgaaatttcatttacattatattatgtgtcctattgtttaagacaatttgcattttttccattacttgcaactaaaatcatcctaactgacacatatattccagagaaaagagagtttgtacaaaggcacagtgttgagaataagcttgtcatatttagggaacagcaaggatgctaccatcgagttgtaaaaaagtaaagcaggagttaaatggttctgggcactaaaaagaaaggctatgattgcaaatataaatggcttaaggaggtggaagcccagtttaatggaattaaggtggtcaacgtgtcaagacaatgctggcattttaggtatagagaaattttgttgcctagttgaaaattttcaagtgaccttgggagcctgataaggatgtaggttactggcagagctgggcaaggagtgagtgattgatattgccaaatggcttatgagacacaaaacaaaaataacttgttttggaaaaagtttaagtaaaatgattattcctgttaaagatttatttaagttgagacaaaaaaattggagacagagaatttttgtgagaagtttgagttcatagggaagcttaggaaacatgaaatttgatttccagagagcagagtgaaaaatgttttcaggaaagatagggcttagataagtcaaagaaaaagagaaaaagaggggaaaaccccatccaaatctctcgctctctcttcctctatgtattctaaatgtccatatatttaatgaagaacagatagtcagtggggaacactagcagacattaaagggatatgaggcatgaagagaatagctgactttggaatattacgtaacattgtcatttcagtgtaagctgagggttttgttgtgctcaggggcataaagatattagcaaacagttttgttttttttcttctatacagaaatatatgaggagattgttatgaaaaatctgaagaaattcttgttcatccttggtcagctgtgctgtggatgggattagtttctagaatcctctcctagtggaaaaaaaaaagtgtaggagcatagttgagtgaactcaaaatggttatgctccaaaaaaataacttattgttatagatcccagagagagtcttcagccacacagaaagatttgtggctttgttctctaaacggagcatacaatattgtttttatgggcagactatgttcttttaagacaggtaagataaccaaagaaggaaaataagcttttcaaataattagcaatccttagacaaaacttgttttcctttcttggttatgttacctatttgttcagtagacagaggctcttagtgtatgaactaagagtagacattgtaaataaatattctttttctctgttaaaaaatgtgcactttaaaactgctttaaaaacttgcttgtttttctttacaaagattatgaaactacaaggtcatataaaaaaagtcatgattcaaaattagcttattgagtgaaaagaatgcatttcattaatacaactaaggaagaatacaaactgctacaatccaaagaagcacattttataaagggaattacataaacaaatattttggataatgatacaagacttggggatactaaatacttcacctacattttacagaattattttctaaataaaccagataagtgacagaataaagaaaaaactttctataataaaggtatttctggaaagcttttatttcattatattccagcttctgtttttaattataattatgttgttatcattggctcaaatatcttgcctttccctgtgaatctatgaaatatataccaatttctcacagcttaattttattttctctatgggattatctgaaatcatttctgttcttagtggcttcacatctcctagaggttctgcatcaatcaagttgtactaaattacgccttgctttgcttaatatttttattatttatttttagacagggtctctctctgttgctaggctgagtgcagtggcaaaatcatggcctattgcagcctcaacctccctggttcaagcgatcctcccacctcagcctcctgagtagctgggactaaaggagcatgccaccatgcctggctaattttttgtatttttgtagagacgcagcttcgccatgttgcccaggctggtctcaatgtcctgggctcaggcaatctggctgctctggcctcccaaagtgttgggagtataggcatgagccactgtgcccagcacctgcttaatatttgtataacttaaacctaccaacctattaacattttttaaaactgtaaatgtgttgtggacagaaacctttccttagtcatgttgtgcttctttatttaattttatagggaaataatgataatttggaaatttgcctctaaagattcttataaggattgaatgtgatgatctgtgtaaagcatttaccatagtgactctcaccaagaaagactaacaaatgttactagtgataatgaaaacaatataatgaaacaaacttaaacttttaaaattatataataatcatctaaactttggggaattgttaatatgtaatttttatgatatatatgcatataataatgcaactctaaaaattggtaacactcaaattgcatgtgcactcattaaattatttggggtttgccattgattttttactgagcaatgctatttaacaattatacatacaatagctcaaataaagtcagcctacatttcttcagaagcagtgggtaggaatgacccagaattattcattgttgatactttcgtttatatcatattgctgtccttgattcaaacttgaaagcagtttaggatactattttcgcccacagtggcaaatgcctctgatttctgctaagtgattctctgatcaaatcagtgtgagtagagtcaatttagctgggttaatgggatttggcttctcaggataagtagctatttcagtgcctatgcacatttatcttctttcacagtggttaacaggcccctaatagaatgacagatttccaggggtcaccctataaaaatatttggatttcttaacaaaaaaaaaatgttatataggtaaattgatagtaattcattagtataacatgcttaataaattataagtgtttaaaaacttatggagagcttcctttaggtgaatattatttaaagcaatagtatataaatatgagttcttaaaatattaataatcacgtagggaagttaggcccattgaatctatttgtgaagtaaagtttcagtgagagtgtttaggaaaataaaataagtgaaataagatttggaatacagtagtctccccttatccatggtttatctttccacagtccaaaaatattacagtaatttgagacatcatatttatacaacttttattaccgtatattattataattgttctattttattgttagtgattgttttaatctcttaccgtgcctaacttatgaattaaactttatcatagatatgtaagtagagacatatctcagagatattgtgagtttggttcgaaagtatcacaataaagcaaatagagtaatatagtgagtcacacctttttttggtgaagtagtctccttctggatgactttcaggtagtctctttctgtctctttgtctcagacttaaaaatacttttactttgctttttggcatgaatcgcttaatcagtcttcctgttactctgaacttttgcttttttccaactctgcctcattattttattcattaatttcacctttacagacttcctgctatctgttagctttgctccaagcattggaattctagagatacaaggcagtcactggcttcatggagatcttcttgtcttaatttcactgtaatatttaattcaagtcaattaagtaaaaatttactagcatttcctatgttttaatcatcctgaggaaaagaaagatggagaactgtctccgatcttaagaaattcataatcagattagagagagcaatatttacaaacataggaaagtgtattaaatgttgagataaatgtttttttaacttgttatgggagttttgagaaaagatctgattttataccattgagaacaaggtagagaaagaggaaggcttattactacatttgacataaatggttcatttcctcaatgtgtgcacatccaaaagagacccattgccttgttgtcgttttactggtgtaatttcccctgagaaatttaactaaagttttcattttttatatttctttatagttggaaggcctagcagtcctagatgaaagacagtggtgatatatgttgaggagtgaaggaagttggagaaatgggcacctggggaagaagcattaagtgttgattaatttagtccaacaaatgtattgaacacaaactatgccaagcactgttgtaggttttgcacatgcagcagtacacgaagcaaaccaaaatctaccctaatggaagttgtattcctagtgaataggatacttaagaaataaataaatatgcaaaaagcatagtatgccaaatgatgagggctatacaaatatataaaagattttaaaaatatttttatatctcacagaaaagagagggggatttttagagtagacctactttacatagaatagttaagaaagtcctcacttacagggtgacgtttgcacagaaacttgaccatggcaagggagtgagctgtgagagtatctggaggaagaacatcacaactgagaagtacaatgcccctgaggtacaagagacaacaaggaggtattccagggtacagtgatcaaggaaaagagaattttaaaaatgagatttacagagagagcagagagtcaaatcttgtaataacagaaatgactgtgggctgttcaaagagtagggagagagaataactatggttaatagggaatgagtcattaactcgtggtcaacataccgaagatccacatgcaagtttaggtagcagaccaggaattcaccctttccaaggacaggaattcagtctagggaatgtttaatctgattttcctatttttagaaagtaaaatgggcagaaaggacttgaatttggagtcgagaagtttgtttcttgtttctgctctgcccctaactagctatctagggctaataaattttaaatctctgggtttcctttttgtttctcctttgaaatgaagagatgttttctatatgttatgtaagctttaaatattcaattcaaggctaagtggtgagtccaacctagtgctacaaatacttactatttttagagggcccagaaagccaggtttattcttattttttaaacttttggggaatcctataaaataacagttttttctgttcatttctttgtttctgagagaaggcctattcctctggctagttttccagcttgacttctgagctcaacaaggtagaagacagaacagtgaatctggaggcattctctgagatctttgcacacaacggttcatcatcctctgtaaagggcatatgcacataatttctgcgggcaaaagcttaactttttaaatagaaaacaaataaatagttacttaatttctccattttaacatattaatatagtttatgatctacatttcagaatattttatttttttagataggatcttgctatgttgcccaggcttgagtgcagtggctcttcataggcacaatcatagctcactgcagcctgaactcctgtgctcaagtgatcctcccacctctgcctcccaagtagctggcctacaggagtgtgttgccactcttgactacatttcagaaatttagaaaccatgttcacatatgagttaatgtatagcttggtctgggttttcaatgttaagttcaagaaggacttttttctttcttattttcaactacaattttatgcataatttatcactgaataatctaagtcctgaagtaaaaatattatattatgtagatgactcataagatagaagatactgctctaattttacttagttatcctttttgacctatgaaaactggattattctcaaggccttattgatgccattgtggtcataggttccagtgcctgagattcaaccaatgagttaaatacctaagctacaatgacatccttttaaaggggccacaatgtaaggcagaaaatacaatatcaattacttattgaaactcaccatcttgatagcaaaagaatcccagagcatacctcttgctgaccctgagggtgaaggacagcattgaggaagcatctagaagggtgaagagtgaacatactgactatcacttcaacacctcattgaagagtcagtgttggtaggttggtttttccaccagatcatactagagttattctttccttcccctttaaaaatttctataccactgtgaaaggaaaatatcttgggcccccaaaaatcactaaggaagactcaagctggaaactgcttagggcaaacctgcttcccattctattcaaagttatccctctgctcactgagacagatcatatttgattgcctccattggaaaggctaatcagaaactcaaaagaatgcaatcattatatctcacctatctaagtgacctagaagctccctccttggaatcttcaagtcttcctgcctttgcttcaagttgtcctgcctttccggaccaaaccaatgtactgcttacatatattgattgatgtctcatgtcttcctaaaatgcataaaaccaatctgtaccccaaccacctcgggcaaattttgttaggacttcctaaggctgtgtcacaggcaagtcctcaacctcgacaaaataaactttctaaattaactgagacctgtctcagattttctgggttcacatcactatctagaaacccttctttacataatacagcttcttgaaactaaaaaattaatatatacattagcttttgctaataagaaataagtgaatggaaaataaagagaatatgtggatgatatgattagcctttgtgtccctactcaaatttcatcttgaattgtaatccccataatccccacgtgtcaagggagagaccaggtaggagtaattgaatcatgggggtggtttcccccatgctgttctcctgatagtgaatgagttctcatgagatgtgatggttttataaggggctcttccccctttgctcagctcttctccttcttgccgccttgtgaagaaggtgccttgtttcctcttcaccttccaaaatgattttaagtttcctgaggtctccccagccatgctgaactatgagtcagttaaacctatttcctttataaattacccagtcttgggcagttcttcatagcagtgtgaaaacaaactaatatagtggatgaaaatatgagatacaaattggcaatatttgttgattgattaaaaatgaaagatccagggaagagggaaattagcaatgatgccagatataagtggcttagaaggtgtaggtgacaataaattgaaaattgaggaaaaagctacttagggaataagagaatattacagcaatgctctaattcaaggaagaacaaagcaatgctaagttaaacttaaaataattttttttaagaattaagagttattcaaataaatgtttagtggtcaatctttttatgtctttaatgaattatttgattttttttttgtagtgagacttagctgtatcagttttcatagttagcataaatgtaattgcttctaaactgggtgaagcatgcatgagcactttggtctgatttgggtaactatagcctaggaacaaaaggtgaagccttggtaagaaaaaagctaataagaaggcaagaagcagaacacagggaataaaaaatattgtcttcagtttgaatgcaacattgcatcatttgttgcttattttgtactctgttctgcctgttgaacagttaccaaatttattctgtctttgttcccttggtaatctaagggattgtgtcatttgacattgctccagtaacagtgatttctggaagtggatatatcatttgtaaagaatctggaagctatgcaatggaagatattacaaaaggtatgttctcctgaggtgttgaagccagaacaactcccacacctactttatgtgaatctcattcctttttacctgaactatatcacctcgaaagaaaaagaaatagcttatgaatgaattgctgcagagactgttgtgaaaaaaactcccatgggaatggatgtgctttctttctggaagcgtggttcctgacctaaactcttcttactagactgctatgaaagtgtaacataagtgtctgaatgtcagttaaaactaagaaatcttgctactgagcattgcagaaccaaagtaggaaaatatattttttctatgcttctcctactgctccttcaataagcaatattttctttttagttttaaagctgctattgtttgtatcatttgatcctttaaaggggttaacatgtcaaattagtcagaggaaactaattctttctctgtatttgttaccagattggttataacgaaaatgcattagcatctaaaagttgtcaaaatcataaaaaaaaagatctagcaactaaattatttgatgttagtgcataagtttcaattaatcacatttttcactttctgacatgctaacataaaagatcatgaaaagccattattttattttattttattatgttttttaattcttattccctctctaattccaagcctaaccataatacctctgtaatgtcttaaaaatacatgtatgcatgtatgtgtgcatgtgcatatgtggaaagagagaaagagaaagatatatatcttatatactttatatatatgtaagttttggatcaggtggcttattttttaacaatgtgatccaaggttgggggcggtagctcacgcctgtaatcccagcactttgggaggccgaggcgggtggatcacaaggtcaggagattgagaccagcctggtcaacatggtgagaccccgtctctactaaaaatacacacacaaaaaaaataagccaggcgtggtggtgtgcacctgtaatcccagctactcaggaggctgaggcaggagaattgcttgaacccaggaggtggaggttgcagtgaggttagattgtgccactgcactccagcctgcaacagagtgagattctgtctcaaaaaaaaaaaaatcaaaatttataagatttaactaaagcagtgcttagaagaaaacttatagctgtaaacatctatatttaaaaagaagaaaaaactcaaatcagtaactcaaacttccactttaaaacaccgagaaaaggagcaaattaaacctaaaggaagcagaagaaaataataaagattagagcagaaataaatgacatagagtatagaaaaacaataaaaggaaataaaatcaaaagttggttatttgaaaatataacacaattgacagacctttatctagataccaagaaacaaacaaaaaactcaaattactaaactcaagaattgtagaagtttaagaacattgtaggatacaagatccatacacagaaatcaattgtatttctatacactagcaatgaacaatctaaaaaaaacttacataaataattccatttatagcatcatcaagaaataaaatatttatgaatatatctttttaaaaaaagttcaatagaccaggcacagtggctcatgcaggtaatcccagcactttgggagtccaacatggaaggatcacttgagcccaggaatttgagaccagcctgggtagcatgatgagaccccgtctctataaaaaaaatttttttaaattagcccagcattatggagagcacctgtagtcccagcaacttgagaagctaagacagaagaattagttgagcccaggaaatggagaccatagtgagccatgatcatgccactgcactccagcctgggtgaaagggtgagatcctgtcccaataaataaataaataaataaataaataaataaataaataaataaataagaagtacaagacttttatactgaaaactataaaatataacttaaaaattaaaaacaaataaatgaatggaagacaatattgtttaagacatcaatactctctaaactgatatatagttcagtgctatccatatttaatctgtatctatatccaagctgtttttttccagatattgacaaactgaccttaaaattcaaataaaaatatgcaagagactcttttcttttttttttgagttggagtctcactctatcacccaggctggagtgcagtggtgcaatctcagctcactgcaacctccgtctcctaggttcaggcaattctcctgcctcagcctcccgagcagctgggattacaggcacccaccaccacatctagctaatttttgcattttttagtagagacagggtatcaccatgttggccaggctggacttgaactcctgacctcaggtgatctgcttgcctcggcctcctaaagtgctgggatttcaggagtgacccacagtatccggctgcaagaaactcttaatagacaaagcaactttgagaaaggagaacaaaattagaggattcccacacctaatttcaaatcttcctacaaagtgacagtaattaagacaatgtagtaatggcataaaaataagcatatagatcagtgcaataaaattttaaatcaagaaagcaaccctcacatttgtgattatttcattttcattcaatgagagaaaatagccttttcagtaaatggtgttggaaatcaataaattgatgaatggatggctgagcaatatgtatcatagccatacaatggaatgctattcagcaataaaaaagaatgaagtaccaatatatagcatgaatgaaccttgaaaacaaaatatagagtcaaagaatcaataacaaaatgccacatattatatgactccatctacatgaaatatatagaataggcaaattcatagagacaggacttagattgctgccagggcctagggtgaatatatttgttagagtgagctgaccttaagcaactgtaggccctatttaggtagcttttctaagtggtaggtcttgaattccacaagatatgctgtcaggatgggacgatgaataaagtaagggagagcaaggataaactgcaacccacaacataagctggatccatgaagatggtctgaagcctgtgtcagctcttcttgcccttgacttgggttgtatggataatctgcaggggaaggtcatgccttttgtcatggagctaaaaacacacatcattcctaatacatgcagaagcaggaggatagaggggaaggtgaatcagttgcacggctgccccacaacaatgaggtgagtcagcaggtaagctatattaagcataaactgtacagtggaagccctttcagttccacccaccaaatcttaaacaagaatttctcttgtggcccaaccttagtggaaaaatacagggaagcaaattttgggaaacagttcagcctaaccaagttgaaacatgatataaccaccaaagacaccttttaaaaataagagaaaggggaatagagtgggaagatgttaaaacagtctaccaaaccataataataataccaccaataaaagtcatgtaacattaacaatagtcctgagactataatataacaatatatcatgatggaatataataaagaactcagaacagaagcatgcatatttaggaacttggtgtatgatatacatgacatcacaaacaagcagtagaaagatggattatttatagatggtgttggggaaaccactttggtatataaagaaatgagaaattgaaactaagtcctagaaaattccaaatgaataactatatatgaaaggtaaatgtgcaagactatcatttttactttggtgtgtaagctttgtatattatctaccaattcaaatttactcattgtatgaattgtcttgtacatctgtggttattttcttcaagacgagtcatagttttcaaataaatcatgactgtgttaatataacaaattccttatgagaaatcatgaattatcattagtgtattagtctgttctcactctgtgaaaaagacataccagagactgggtaatttataaagaaaaggaggtttaatggactcacagtttcacgtggctggggaggcctcacaatcatggcagaaggcaaagaaggagcaaagccatgtcttacatcatggcaggtaagagagagcttgtgcaggggaactcccctttataaaatcatcagatctcatgagacttattcactatcattagaacagcacaagaaagacccactcctgtgattcaattatctactaccgggtcaattccatgacacatgggaattatgggagctacaatttaagatgagatttgggtggggacccagccaaatcatatcaattagcatttaattttgtattgcaaatctagagacagatttacccctttgttaccattttttgtcatgtataattttaagaagactaatgtgcatgttattcgttgaattatgctctccctgcaaaaaaaaatatatatatataatgaagtcctatcccaagtagttcataatatttggaagcagagtctttacaaagactctgcagagctaatcaagttaaaatgaagtcattagaataagccctaattcaatatgactaatgtctttatagaaaggagaaatctggatacagagacagatacacacagggaagactctttgaaggcaggaagaacatgatgtgacgataagattgagggaatgcatctacaagccaagaagcacaaaaaattaccagcaaacccccagcagcaacaaggaggcaaggaaagattctctacaggtttcagagtgggaatggctttgtctaccccttgatttttgacttttagtctccaggactgtgagataatgaagttctattgttttaaaccacccaatgtatgagactttgtcagccctatgaaactaaaatagtacattataaaatttattatattaatgcatatactacaaatttataaatatactatatttaggtcttcaatacatgtacatattatctttaaaatgatatcagaataatttgaaataaacgtaaaggccaacagttttgttctgatattctctgagctgttactgaaggaagtaaaaagaaacttactcttcttgtcaaactcagcattataattattcttttaacatgtgatcctcataaaagggttaactgtaaatatattgactaaaatatatgtaataatactttggatattataaatatgtaatgtttggagattttatatgtaatgtttggggatctttaacaaggaattatacccccaaaacctccaagtataatatttttcaataaaaaatagaataattttgtcatcatgtttccaagattctcagagtgatttggaaattattacattattctcataacacctaaagcatgtactaaaagtttccttatatgaaattaatgttcaaaataggtataaaataatggaagttacaatatattatccatttaatagtacttcattagtaataagttcaaaatactacattctgaaatgccttataattctttaacctttgaagttagaaatatacattttgattaaatatatacatcagaaataattacagtgatataatccattcatcacatagtactttgtagtttaaaagtgattttgcatgccctctgtaatttctggcttataataccctatagatgtaaaacaagcataaataaaacaatgagggtactaaactttgctccgagtatcatagtttcttaggggaaaggctaaacacaaaggattttcatctcgttttttgcaaatatgttcatgtttaaaagtgtctaattttaagaatctctatgcaccaatatagcagtactgacaatatgaacaattctattaattgggagtagctttaaataaaaaagggaagtctttttctgatccctgatttcctttcacaacatatctactcctactttatctatactcctaaccaatgtccagtagtcttccaaaagtatgaaagtccaaagtgtgggcttcctacagatgagatgctgacctgaagaaatcctgtttaatagtgtagttttatttattatggcatccagataggaaaaatatgcttaggcactgaggtattctatgaactgtttaagttataacaagtaggcttctacctatataaccagtactggatgatgggtcaaaggagaaaatactagcataatcatgaacatggaaactttcccatttttatttattcaaccacagctcgagaccctaaattgaaaactcacaatacagcacataagggcaatggagctctgaagagggtacgttgctgcttggtgaccatcgggacagtagaaactaaggatatttaaacctttaggataagttgtgatacttgggctttttattctctacctcagtgatcaagctacataaaagagcccggggttccctgctgccaacatggtgacactatgttaatgaatcttgatccatgtgccctggggtttggaaaagacacagaaattgatgaccacatgttacctggaaatcctaatgacacaatactccctagaagtgccttttagcgtgaggcaaagaaacagggttattgtagaaatgaccacgacccttaaaatttggtggcccaaagatgctgagtttccctgtgggtcatgaggaccctatagaaggtaacaggtttgaatcattctgaaaggactgccttgagagcatgacacttcttcacaaaaaaacggaggaaaaagtagtacgatccagagttttcatcactaattcagggaatagagttatggaggggtggtggttgggggtgttaggacaggatataggcattaaagagagtgtggtagattaaattattatccagaaatattcactctctcttgtcctcaagttcaaggaaggcatatgttctccattgatgttgagcttacccttgtgatttgctttgacctttgaaatgacagtagatgtgctacaacatagattttaaatatgcttgtacactcactttaacccgtcctcccttatgcctttgccgttatcaagagaagaatgtgactcagaaagcccactcatcccagagacaggatgaggatgaaagagaggtggagctgagccactcctaggtaaaacaatctagattagtcaactataccagtcaaaccacagacttctaagagatcataattggttgttgttttaaacaatcgagttttaggctgtcctataatacaacaataactaattgacacaaggagatgcttcaaagatcctaagaaagtgtactgcaagagaaaaagccagatatgatgttaactaatagtaaactggactagagtttttaatacctgacaaactacagttgcaatacccacaggtgactagatagctgctgtaggttctctccaggatattgatcaaagacaggaaaggtaaaaccatcagagatggtttctagtgggatattttaggtatatgtaagtatgtatacaaattaaaagttatattttatttcctttcaggaataattgctttaaaaaggtgaaatgagagagcgaaagtagaatatactcaccccaaagtaagtcatccttccacaaaatcatccattaggttaatttattcctttagcattggtagggtagttttgataatgtatggccacattatagccctcatctactagacaataaagttacatattaattctagataagtagtttgattggatccacggtgtctttacccatgaagcaaaggtttttgcatattattaaaataactttagtaacccactaatccaattgatttttcattattttggggtaattttagacttcatgttcatatctttaaatatgaaaatcatgaaaatggtaattacataagtatagaatttatcatagctacagtaataattagaatatgaaataaaatacaccggtataaactcagtttgtctttgcaattttgatgttaatttgtttaatttactaggtttaatttactatcacctcaggagagatgtcccttacttccttgagagtggagctctttaatcctttctatttgtagtgcaccagaggtgatctgatcttgcctctagtccatcacagatggagaatccctaggaatcaaaaagtagatataattttctttccctgctgactgctgctatatctacctgggggaaaaacaaaaccaaccaaccgacaataaactgctatatggggtttactttgtccttttattgaagggtgctttacatgtcctaaagcagctccgaatagaacttggacctgtctctttgtctaacctcttatggaaggggctgtgagaggcgaagtcacataggaaaaattaatctccttggatatctgtatactcaaggataaatacattccttgggggaaaagtaacctaaaataaaagagtaaagaagtacaattgatttaaaaacacggcatctgtattggaaaaagacatattgcttcttctgtaaagctgttggctctcattagattatcctgtgccccacatctctgaacttatgtttaaactccagaaagagaaagctgcaatgaaagcaaaagaaaagcttcagtggcagttactttaaattttacatgaaacaatgaaagcactacttgtggcttttataaatgagagcaatttttgtagtacaggtgcagcacatagtgtctattcagaccagtttacttttagaatagaaaacaggcactggatcttggcacttttagcatgagtggtgctgcctttggtgcaggtcttgatgatttggcagtaggtaccacatagaaatagagcaggaatgtgaaaaaccacagacacagaaggtgataactctgataaatacttggtgagtaggtaggagacactgtcctaaagattaaaaaaaaaatactatgagggtggaatttgggggagctggcattcctgcagaaatgagagaatcaaagcaagagaaatcatctttgtttgtttaaaaatgttatcatgattctattattatgcccaggttggtgtcatctgattaaacacagtgaagctactgacttgatataattacatatagaaaatttggaaaataaaaagaaatagaagtaaagccacaaaaagctgtctgctattacatagttagaatctttggacatttaatggagaaaatagatttggatctagggaaacatcagaaccatgtagttgctactataccatatttttaaaggtgatctgtgagatcattcatttctgatttaaaagttttttgcacattgctctctttctgatgtgaactacaaagttgaaagggaacattaagaaatgaaaatttgacagatgtacataataaaatgactgcaaaagaataaataaggttacacaatgaaaatttctgatataattaatactaagagaaatacaaagagcaatttaataatcatatttagatattttaatataggcaagaaagagaataggttattctttgtttccaatatgtgccaaaaaatgatatagctgaaatttctatccatgtcttcctgcctctaaatctattgcttttgccactccacaggttgcctcagagttgctgaggtcactcttattctctcatgtttgctcagacctccacttcaagaacaggtgatttgcttcacttcaaacaattttttttgttttattatttctgaaagtttcagaatgaataaattgaatttttaagaatgatcaaatgcacaaggtgatcttgcttttcataacttaacagattcttatatgacataaataatatcaacttatttatatgcattacaatttttaaatttatacattgtgattcgttaaagattattgcaacctatagaatgatgttgactcaaaagactaaataagaaagattagcaaaaaaatttgaaagggaaaacacacatttttgttcctttattcataaaatgcactctgtgtcacaaatgctatagtataagaatggtgtttaaaccaatcacttatgggaaaatatgaagggtagatgatgcacataagtaataagaaagacacagagaaaaaaatagcagtatctttttcaaatatttattattagtgtctggcgacatgcttggggaaaactctaatagaacttatttgcaaatttagaaatattaaatctattataaagccagatctacacagatacaattatttctatccttagggataaatgaatctttgcttaatggtttcataaaaaatcattttgttcaacttcaagtcttgtataaacagatattctcaagtagagataataatgggagctttttaatatacttttatgtacttaaaaaacgaaatgcatatttctgaagtaagccctcagtgctttagcaatagagtattgtataaatgaaaatctactttaaatgaaagcctagcagaaatatattagctcaagggagtatataaaatgttcatgctgcctgttgaatataaattttataatggaaaattaattttattgctcagtcatttaaatgattatttatattgtttatgataatggcaaattattataaaattttagcatttaggacaatacttacatatcaataaaatgtgacatttatcttgtatgttaacatatacatatagtacaataacaatttttaacagacatatccaaacttatccatgcgtgcattttcattagtcattgtattttcttcacagtcgacaaaacttatataggaaactctttgtcttaccttctaagttttattttattttattttttctaaattttaataaatacaagattaagaacaaaaaatggatcaattattcaaaacacagttttgtcctcatccaaaaaagaattctcaatacctttgggctgagaataagatattgcagatgattggaataagtttatggtttccagggtggttaatttacaggtaaccttgtagtttccctctgcctgactaaactttaggcagccttccttctgactctaggtcctacctccctttccttagagcattttatttagaaaatctgtaattgtaaattatttctccacccttttgagaagtaaatccttttaaaagcctctcatcagttttacaactcacgaatttctgaaggatctgtttgccatgtctttaaaatataaacattaagagagatagcaccccatctcctactttctatgggagggtagtggcccaacttgggtgggtgactgctttgctcaaagttataaaattacttctttttacgaaaatatgagaaagtttacttttcttttgggtaagatcagttggcaacacaaattgcctatgatcttcatccctggcttttcaaaaactctcctggcctcagtttcaatgcagttgagttcatacgataggtaccctttatccctagtttgactttccatagtttcagttacccacgcacagtcaactgcagttcaaaatattaaatgaaaattccagaaataaagaatttgtaagttttaaattacatagtgttctgggtagtatgataaaacttgtgttgagagacaagactagctgggtttcccaggccgactaagaattcctaagcctagctggggaaggtgaccacacccacctttaaacacaacacagggcttgtggcaggtaataaagagggctcactaaaacaccaattaagttaaaaacaggagctaaagaaatagtcaaatcatctatcatctgagagcacagggggaggaaccatgattgggatataaaccccaggcattccagcccagagggggcaaccccctttgggtcccctcccattgtatgggagctctgttttcactctattaaatcttgcaactgcacgctcttctggtccgtgtttgttccgtctcaagctgagctttcgcttgctgtccaccactgctgattgccgtcgtcccagaccaccattaacttccatgcctccggatctggcagggggtccgctgcatttctgatgcagcgaggtgcccattgccgctccggtttgggctagaggctcgccattgttcctgcatggctaagtgcctgagttcatcctaatcaagctgaacactagtcgctgggttcctgggttctcttccctgacccacagcttctaacagaactataacacccaccacatggcccaaggttccattccttggaatctatgaggccaagaacccaaggttagagaagaaaaggcttgctgccatcttgggagcagccacggccatcttgggagcagcccaccaccatcttgggagctctaagaacaaagacccacctgtaacagtgtcacccagcttcatcccacccaccatgtgaatcactcctttgtccagtatatgcaccttgtatgtgctactcacccattagtcccctagaaaccatctcagttatctgatcaactgtcaaggtaccccagtgcttgtgttgaaataaccctattttacttaataatggccccaaagcacaagagtagtgatgctggcatattgttataattgttgtataattattagttattgatgttgatctcttacagtgcccaatttataaattaaactttatcattggtatgtatgtataggggaaaacagtagtcatgtaccacataatgaagttttagttaatgaaaatgcacaatgcacatgcacaatggtggtcccataagattataatgggggcctggtgaggtagctcacacctgtaatcccaacactttggagaccaaggtgggaaggtcgcttgaggccagcagtttaagaccagcctgggaaacatagtgagaccctgtttctaccaaaaaaaaaaaaaattaaaaattagctgggcatggtagcgcatgcctgtggccccagctatttgggatggtaaggtgggaggatagtttgagcctaggagttccaggtcacagtgagctatgatcaccccactgcactttagcctgagtgacagagtaagacctgtctcttaaaaaaaaaattattatggagctgaaaaatttctattgcctaatgttgtagtgcaacacattacctttactatgtttaggtacacagataccattgtgttatagttgcctacagtattaacatgttatatagatttgtagcctagaagcaatagactataccatatagcctgaatggtagttggctattccatctaggtttgtgtaagtactctctatgatgttcctacaacaaaattgcctattgacacatttctcagagtatatcctcctcattaagcaatacatgactgtatttacctaaagggcttgatcctgtctgaggtttcagcatccactgtgggtcttggaacctatcctctgtggataaggtggggagaagtcttctgtactgtattctggtctctctctattttattgcaatagcattcaatgaaatctttcttgcctgtttaactttggtgttgctttctcagaggacaaatttttaaattcattctctccatacttacctacacatctattatttctaacatactacttaaactttagttagatgagtttgggaacttattcaaaatgattctcatcttttatttttctgtcatatgcttatggagcaagtaatgagcattgatgaaaaacatcacaaaacaatgtaattagttccactttgaaaggatgctatttttttttattgagttttcacagtgtgcacacctctattcagtggctttgtttaaaacttttatattatctatatttaccttaaaatagctcagtatggaccaacagcacaatatttttaactctccctttactattatgaaatagaattcataaatgacctacttatacaaataattttttaaattgaattactgcaatatagcatgaaacatagctgtgacataaaaaagagataaaagaaaagttataatacagctaattgcattgtttttgaaaaaaggtcatgtaccacttgtgctagaaagcataatgaaatagctaaatgtttcaccgatgtttaatattaccatgatggcaacagtctcaaatgcagactgatacagggatgctgtattaatgattcaattagtacaaataacattgctattggtgacattgttttctgaaattacacgcaattcttgataaatacttgaacaatacaaagtattgtcccttgactcacatgtcacttgcaatattgaaaaattaacagttcccaaacacaatgcagaaacactttatatttttatataaggcagggatgaagcctgggttcagatatgtataaataagataatcgcttactagaattgtctatcaggtagatcatttggaattgtgtgggattcaatctgattctgctttgtaagatactgtcctaagtcatgcaactctggccctcaatcattgagcactcaacaatgatatttgctgcgactgacttcaatcaacactttaggaagtgtttaaattttaagtaacagaatgagttgtttacaattcaagggtgtttaattagcatttgaaagactttaatcaaaggcccacacttcagccacaagtatagcaagccattcaattagtgttatcttaatctacactagagaatttgttaattaacataaggaatggtaaaaataaattttcattatctaaatgagagttgtacaagatacatgattggttaaaaacaaaaagtacagttatcattaatgagatctaaaaatctgaggagctcagcaagcacactagttccagtgacccattaagacttgtccctttcacttgctagaagattttgtctcttgatccaactataaagttagatcatcctaacttgtccccttgtgaagcccctttcacagcaggctcctttctcttgtatccacctgcttcagcaacttttctgcaagataagcaatcctacgggaccgccagatggttacaagttcctgatacctagtacagccacggaaagagaacaaaagcctcttattcctgatgtagcttccccattctccagccaatcaacacccaaagcccaagaaaccacaggttcctgcctgaagctaggactttatccacacgtgcagctaggctcaaggtttagcttacagtgaacttttcctcattttgatagtagaaaacacacccctaggtgagattttataagctaatgatgcacgagatgtgtgttgggatatgcagatgctaagcccctccaccaaccacaggtccacctttgcataaattgacttcactagtattttatgaatgaatatgtataaacaactcccataaaacaatggccataaaaggaattccttttaaggaactagctgctgtctctccctctgagcagcccactctgcctctcagagtgtactttcactttgcaataaaccttgcctactcttactttgggcttgctctcaaattcttctgtgtggtaaagtcaagaacttgagttggcctaccaagaacagttggactgcctaaaaggctaaacagctaagacttcatctagtttacattaacatgactttaactatttttgaaccttctaaacatgcaataattcagcctgagtcttactgtgatggtagcatacctcccagtagtgaggttctaggaaaggagaactacagctcccactggcttcaaattgttagctgctgtcaaactgatatgggtacagttctcatccttggatgtccagtggattcacctaagaagctctaaaatatattgatgctgaaagacccgaaggaattctggttaattggcctggtgtgtctgagcattgaacttttaaaaactcccctggtaatttcagtggtaaaagttaagaactgctctcctatgacctttcccacatcatctgattgaaaacattttcctatttgtacaagcccaggtcattctttcattttttttttcttttgaaacgaagtctttctctgtcgctgactgcggtggcacaatctcggctcactgcaacctccgcctcccaggttcaagcgattctcctgcctcagcctcccaagtagctgggattacaggcgcccacaacacctggctaatgttttgtacttttggtagagatggggtttcgccatgttggccaagctagtctcgaactcctgacctcaagtgatccacttgccttggcctcccaaagtgctgggattacaggtgtgagccaccgcgcccagccccactctcaaacttttaatacttaagtaatatgccatctagttattgggggaagagaggattttcaatgagagtacttttgtttgtcttcttttttgcctttaggtttctctgtcttcatctgtctatatacccgtctatggaaattggaattctcttccttgccagagcaaacacacttattgttgtttggaattagactcacctttccctactgtttcaaacacaatgttacctagaatttggttcatagcatcagtatcacttgggagcttttaaaaaatgtagagtcgcatgcaccatgtagaactcccaaatccaatctgtgtttttaacaggttattcaagccatttgtatgcacttaaggtttgagaagcatttcttgaaggcattactctactaaatagttattagttgcatctctagtctctcccttggctgactctgtttcactaaaaaataataaataaaaattattaccctgaaataccatcctcaatgccttccttccctcccctcaaacagataaacaaacaatgatgaacaaacacagttctcaataatatagtcatacattcatttactcatttatttattaaaaaaaattattctctaataagtattgactgtgtcagacattctctgtgcactggaaatgcagtggagagcagcggagacatgggctcttccttaaaagatttttgaataaactagaggagacggacaattaagtaaataattaatctcaagtttgattattcctctaagagaggaagcatatagtacacatatgcacatgcaatgagatcatattcattagttcaagaaaactgaatggaagtgacatttaaaatgaatcatgcaggatgagtaaatgaaagcaaacgaagttgggagtaagggttgtgtgaaaggaagattcgaggaataaagagcagagtaggattgagggtacaatgacatgcctgagtagctgaataagcatgttccattatacatttattccttccttattcttgtaaacaaactctatattgtaacaattttttatgtttcacttattccataaattctttcagtctgccttctagtgccaacactctatttaaacacaaaagttatctgtgcccacaaaatagtgaaattcactagtattttctcccatgcttattcctttaatgtgatctgtgtagcagagtgcctggtgtgtaaaacttgattaaaagaaacagctggctgggcgtggtggctaacacctgtaaccccagcactttgggaggctgaggcaggcggatcatgaggtcagagtttgagaccagcctggccaacatggtgaaatcccatctctactataaatacaaaaaattagccaggcatggtggcgcacacctgtagtcccagctactctggaggctgagacagaagaattgcttgaacccggcaggcagaggtggcagtgaaccaagatagcgccattgtactccagcctgggcaatagagcgagactccgtctcaaaaaaaaagaaaaaaaacacacacacaaaaacaaaaaaacccaaaaacaaacaacaaaaaaacccccagctatacaagtctcctagatctcttcctataaaagtggagcagaaactccctttttatcagattgtttgttattcaaagaggaacttaaggagttcctgttttaatattagtattagtattagcattattactgtgcctattgctcagggaaaagtttgctgaaattttttgccttcattaaattccttggcagacaattaataccaggacaacaagtggatatattggctttcaaaattatcatgataaaatgtgtaaatgatgaaatctgattaaatggttaaaatagaaatcaattggcttgcattttattttttccccacatcagcactgtatttcagaggcatcactttaaaacaatttttatttcagttcttttcctagttcctgctagagctctcaatagaattcttatgcctctttcccataatttattaacaatatacaatacagtaattccctactaaagtatgtcaagtttgatccagttacaacatctttacctcctctccttcctctcaaatttgatagatatatcagttttttaacaatttgttacatttgaaaatttaaataatatgttcatgcttctatttcttttcccatcaacttttgactttacatcttggttttgtttttgtatttcttgtttttgaggttttagagaccttctgcttcctccacatctcttcccatttttcttcttgctaatatgggcaatataccacattggtaacatctatactgtgttctgtaagataatgaactgttcaataattgcatttaggtaaattctaaaagttgagaaatctactaaccacattactaacattaatatacatttatatggatcttcatataacctagtttcatgctgattacatttccttctttacactttcaacacctcaataattcaggcggtatttttctgccttttctttagcatgtttggatactttcaaggccatacccttgcttaaattctgttttatgtttatctgcctcatttaggattttaccttcccttcagagatacagatagtaggttaggtgttaatgtctatatactttttctagttaagagcactgagtctcttctggaaaatccaggagctgttctgtgctctgagatcctactaaaagtcctgtaccaaggtgaaatcaattatgtggaatcttaagtttgcctattccgtcagatcacataaaaccttggaaaagagcaagccatccctgactgacctatttctggtgagatcgtgtcctggctaagtaggactttcagattcaaaagttcagtgtttttgttttgttttcctttatgtgctatggactattaatgcattcttcagtccaccactctccaatttaaggatgttattgagaagtcttagcattttatcacatcaactccttgtctgaacgctaattccaaaatgatagtttcagcattaacagcccagaaatattatatcagattcttccctttcttttctgagttactaattttcatgttttagggtgtgaggttttagtcttttccttagtctgcttctgtgtgaattttagctgatatattacgatgtattttcaaaaatataatttggcattagagtgtgaagaaatcattttctagctcaaagaaaaaccgtggcctacgtggagacctgaaccagcaaagtgatcattgcaatattggttaaagtttgttttcagtggcagtattctatttcagcaaaaaaagaaaggttacctaaaactggagtgcccaggctactgagatggatttctaattttcatttcacctggtattttaaaaagctggcctgtaatttttgtttgagtattgacccagggttcttttagtctttgaagggaaaaaagagttctaaagaaaattgcttgtcctgctaattttgcctggagcatttaatttgagtgttaaatggaatgtgaccttatttgtatcacacccttggtgatgtagtaatactggctctctctatgctatttgtggtagatgaccactaacttgttgcaaattctttctcccttggttttgatacatagtattagatattgtctcccttattttttttttgtcttttttttcttcccatctaaatgcagtaaccctcaataactaggctttaaccctctttatttcttgttgcatactttatctttggcaacttcaaatttccaagatttacactaatttaaggggttttaacgcctcataacaaaaccaactcttacctatatttctctgatttatttctgttaataattgccacaacaactctttttgatcaccatgtttctagttccttgaaaataaaaccttggagacgtctataatttctccctcatccttagttcacattaaagtagacacatatgtgactcttttctgtagccttacatctaattagttgtcaggtctgtttatttcagtatcaatgttttttataaattctcttatttccattctgtcatcggcctaaatcaggctataaaatgttttacttttattatgtaatcacttatgattaaatgtcatctctcatggtatgctttcctcaaactaattctcttctatgtgccccggaaatactatccagcttaataattcaaaggaatagctctgatcatacagcaatactctcctattgagaaattatcactaattgctcttacaatattattttctgaagcattctttcaaaatgggtttcaatagttaaacaagtataaaatctttgtataaatacaattacaaggtttctttactagaaaatttctcagagccttttattcactgggtactggttgttgttttgttttgttttaattattgtagagtaactcgtaatactaatgtttcttggagaacccatgagaggatgtatgcctacagaattgtagcagatttttaacgacaatattttttccagagtgcacagctaaactatatttcccatcatcccttgtatttatataaagtcatgtgactgagttctagccaatagaatgtgaaggagttatatgtgccatttctgagccatgatttttaagaatggtgcaatctccacagtgtttttcccctcggttggtagtatatggataagggtggggccctagaggacaattgcactacaaaataagaggcgacggtctctgagtcactatgtggaggagagctgcctgccaaccagcgacttccatcttagatggttatgagaatgagaaataaacttctattttgttcaagctgttgtatatttcgattctatttgttttaccagctagcacaaccccaatagataaaggtatgaaatttaaattctttagcctggaaatgcaaagttctttacaatatgggcaccaagtatcatttagaactacttctattgaataacaatagcatatattcttatagtgggcccaaactatttattcatgatagtgcttctggttacaacgtctcttttttcatttaaattttttgaaatttagactcagcttagatgttactttctttttttttgagacagagtctcactctgtcacccaggctggagtgcactggtgtgatatcggctcactgcaacctccacctcacaggttcaagcgaatctcttgcctcagcctcccaagtagctgggattacaggtgcgccccaccatgcctggctaatttttgtatttttagtagagacagggtttcaccatgctgaccaggctggtttcgaactgctgacctcaagtgatccacctgtgtcagcctcccaaagtgctgagattatatgcgtgaaccactgcacccagccatagatgttactttattaattctaacataaaaaagaaacatttgttactagtaaactcaaactttggtttagctttattttaaatgagtgaacattgagatcttttcaaagtgtggtcttcagggtcagctattttagaaccacttaaagtgctgtgcagaacctaggtgatccctctccttttctgtgacatcttatggctctaagtctaactccatctccctctctcccttgtagctaaggtctaaggcctgaatatgatttgggttctgctaataaagtgtgtcagtcctctgagcccaagctaagccatcatatcccctgtgacctgcacatacacatccagatggccggttccttccttaactgatgacattccaccacaaaagaagtgaaaatggcctgccttaactgatggcattgtcttgtgaaattccttttcctggttcatcctggctcaaaagctcccctactgagcaccttgtgacccccactcctgcccaccagagaacaacccccctttgactgtaattttcctttatctacccaaattttataaaacagccctacccttatctcccttggctgattctcttttcggagtcatcccgcctgcacccaggtgaaataaacagccttgttgctcacacaaagcctgtttggtggtctcttcacacggacgcgagtgaaatttggtgccgtgactcggatcgggggacctcccttgggagatcaatcccctgtcctcctgctctttgttccgtgagaaagatccacctacgatctctggtccttagaccaaccagcccaaggaacatctcaccaattttaaatccagtaagcggcctctttttactctcttctccaacctctctcacgatccctcaacctctttctcctttcaattttggcgccacacttcaatctctcccttctcttaatttcagttcctttccttttctggtagagatgaaggagacgtgttttatctgtggacccaaaactccggcgctggtcacggacttgggaagacagtcttcccttggtgtttaatcacgcagggacgcctgcctgattattcacccacgtttcagaggtgtctgaccatgtggggatgcctgccttggtccttcacccttagcggcaagtaccgcttttctgaggggcatgaaccccccaacccttctctctgtgtctctaccccttctctgcttttctggggggcaagaagcccccaccccttatctccgtgtctctactctctcttttctctgggcttgcctccttcactatgggcaagcttccgccctccattcccccttagcctgtgttcttaaaaacccaaaacctcttcagctcacacctgacctaaaacctaaatgccttattttcttctgcaatgccgcttgaccccaatacaaactcgagagttgttccaaatagccagaaaatggcactttcaatttttccatcttacaagatctaaataattcttgttgtaaaatgggcaaatggtctgaggtgcctgacatccaggcattcttttacacatcggtcccaccctagtctctgtgcccagtgcaactcatgccaaatcttccttctttccctcccaccggtcccctcagtcccaaccccaagcgtcactgagtctttctaatcttcattttctacagacccatctgacctctcccctcctccccagggcgagctaggtcccaattcttcctcagcctctgctcctccaccctataatccttttatcacctcccctcctcacagctggtccggcttacagtttcattctgtgactagccctccccgacctgcccagcaatttcctcttaaaaaggtggctggacctaaaggcatagtcaagattaatgctcctttttctttatcccaaatcagatagtgttttggctctttttcatcaaatataaaaacccagcccagttcatggctcgtttggcagcaaccctgagatgctttatagccctagaccctaaaaggtcaaaaggccgtcttattctcaatatacattttattaccaaatctgctcccgacattaaataaaactccaaaaattaaattctggccctcaaaccccacaacaggacttaattaaccttgccttcaaggtgtgcaataatagagtagaggcagccaagtagcaacatatttctgagttgcaattctttgcctccactgtgagacaaaccccagccacatctccacacacaagaacttccaaacgcctaaacctcagtggccaagtgttcctccaggcccgcctcccccaggagcttgctacaagtgccagaaatctggctaccaggccaaggaatgcccacagcccagaattcctcttaagccacgtcccatctgtgcgggaccccactgaaaatcagactgttcaactcacctggcagtcattcccagagcctctggaactctggcccaaggctctctgactccttcccagatcttctcggcttagcagctgaagactgacactgcccgatcgcctcggaagccccttagaccatcacggatgccgagcttcgggtaactcttacagtggaaggtaagtctgtccccttcttaatcaatacagaggctacccactccacattaccttcttttcaagggcctgtttcccttaccttcataactgttgtgggtattgacggccaggcttctaaacctcttaaaactccccaactctggagccaacttagacaatactcttttaagcactcttttttagttatccccagctgcccagttcccttattagaccgagacactttaactaaattatctgtttccctgactattcctgggctacagcaacacctcattgccgccttttcccccagttcaaagcctccttcacatcctccctttgtatctccccaccttaacccacaagtataagacacctctactccctccttagcaaccgatcatgcaccccttaccatcccattaaaacctaatcactcttaccccgctcaatgccaatatcccatcccacggcatgctttaaaaggattaaagcctattatcactcacctgctacagcatggccttttaaagcctgtcaactccccttacaattcccccattttacctgtcctaaaaccagacgaggcttacaggttagttcaggatctgcgccttatcaaccaaattgttttgcctatccaccccatggtgccaaacccatatactctcctatcctcaatacctccttccacaacccattattctgttctagatctcaaacatgctttctttactattcccttgcacccttcatcccagcctctcttcgctttcacttggactgaccctgacacccatcaggctcagcaaattacctgggctgtactgcccaaggctttacagacggcccccattacttcaatcaagcccaaatttcttcgtcatctgttacctatctcggcataattctcataaaaacacatgtgctctccctgctgatcgtgtccagctaatctcccaaaccccaatcccttctacaaaacaacaactcctttccttcctaggcatggttagtaaggtcagaattcttacacaagagctgggaccatgccctgtagcctttctgtccaaacaactggaccttactgttttagcctagcccttatgtctgcatgcagcagctgccgctgctttaatacttttaaaggccctaaaaatcacaaagtatgctccactcactctctacagttctcataactttgaaaatctattttcctcatacctgacgcatatactttctgatccccagctgcttcagctatactcactctttgttgagtctcccacaattaccattttttcctggcacggacttcaatccggcctcccacgttattctagataccacacctgaccctcatgactgtatctctctgatccacctgacattcaccccatttccccatatttccttctttcgtgttcctcacccttatcacatttggtttattgatggcagttccaccaggcctaaccgccactcaccagcaaaggcaggctatgctatagtatcttccacatctatcattgaggctactgctctgcccccctccactacctctcagcaagccgaactagttgccttaactcaagccctcactcttgcaaaaggactatgcgtcaatatttatactgactctaaatatgcctttcatatcctgcaccaccatgcaagaggtttcctcactacacaagggtcctctatcattaatccctctttaatgaaaatacttctcaaagctgctttacttccagaggaagctggagtcattcaccacaagggccatcgaaaggcatcagattccattgctctaggcaacacttacgctgataaggtggctagacaagaagctagcattccaacttctgtccctcaccgccagtttttctccttcatatcagtcactcccacctactcccccgctgaaacttccacctatcaatctcttcccacacaaggcaaatggttcttagaccaaggaaagtatctcctagccttagaggcccattgtattctgttgtcatatcataacctcttccatgtaggttacaagccactagcccctctcttagaacctctcatttcctttccattatggaaatctatccttaaggaaaccacttcttagtgttccatctgctattctactacccctcagggattgttcgggcctcctccctttcctacacatcaagctcagggatttgcccctgcccaggactggcaaattgactttactcacatgccccgagtcagaaaactaaaatacttcttagtctgggtagacactttcactggatgggtagaggccttccccacagggtctgagaaggccaccgcggtcatttcttcccttctgtcagacataattccttagtttggacttcccacctctatacagtccgatagcagactggactttattagtcaaatcagccaagcattttttcaggctcttggtattcagtgaaacctttatatcccttacggtcctcagtcttcaggaaaggtagaatggactactggtcttttaaaaacacacctcaccaagctcagccaccaacttaaaaaggactgtacaatacttttaccacttgcccttctcagaattcaggcctgtcctcggaatgctacagggtacagcccatttgagctcctgtatggacactcctttttattaggccccagtctcattccagacaccagactaacttggactgtgccccaaaaaacttgtcatccctactatcttctgtctagtcatactcctattcaccgttctcaactactcatacatgccctgctcttgtttacactgccagtttacactgtttctccaagccagcacagctgatatctcctggtgctatccccaaactgccactcttaactcttaaagtaaataaataatctttgctggcaggactatgctgaatctccttaggcactctctaattagatgtcctgggtcctcccaattcttacacatttaatacctgtttttctccttctcttattctgtttagtttttcaattcatacaaaactgtatccaggccatcatcaataattctaaatgacagatgtttcttctaacaaccccacaatatcaccccttaccacaaaatcttccttcagcttaatctctcccactctaggttcccatgccacccctaatcctgctcaaagcagccctgagaaacatcgcccattatctctccataccacccccaaacattttcaccgtcccaacactttaccactttttcattttatttttcttattaatataagaagacaggaatgtcaggcctctgagcccaacctaagccatcatatcccctgtgacctgcacgtacacatccagatggccggttcctgccttaactgatgacattccaccacaaaacaagtgaaaagggcctgttcttaccttaactgatgacattgtcttgtgaaattccttctcctggctcatcctggctcaaaagctcccctactgagcaccttgtgacccccactcctgcccgccagagaacaacccccctttgactgtaattttcctttacctacccaaatcttataaaacggccctacccttatctcccttggctgactctcttttcggactcagcccgcctgcacccaggtgaaataaacagccttgttgctcacacaaaggctgtttggtggtctcttcacacggacgcgagtgaaaaagtgtacctatataacagagggacaagtaatatttctgttggcttgtgttgatgccaattgacacacatgctgtgaagatcaaacattttggtagtggttgggccctgcattctgctagttcattacccctttcaatgatggtacctgtggtgtggagtggcagcatttgaaccactggattgtcagccactgcaataatatattcttgaaatcacatgtccagtggcagtcccctgattatcactccttaattaattctaagtattttggaaatataattttattaaaatgcctctctgtttaaaatggctagagtcgtttctatgtcctacactaaatctagactggtacaaattcctagattctaccctagactatggaatcagaaaatatgtagatagaaaccttgtatctgtgttttaacaagctcttcatgtgatttacgtattttctaaagtttgagaaccactaacttagatagtccagttttctttactttctctcctatggtatacataaatgagtacagttagcattacagaaaaagagtgaatctgtcagagaaagaccaagacatgacttaggcctctaaaatatgttgacttcttaccatgttttaatagcttaattcttttttgtgcacatgcccatctgagttaaatttaaaaagctcaaaaattccattgttaatgcttttgttgtttgaccttagaagctttgaaaaataatgctgacaaagtcatactagttgtttttttataacaatatatatgatttatcattacatagttttattttaatgtaatccatatcttacagaacaaaacagtaaataatatattttatggattgaattgcgcccctgccaaaaggatatggtaaaatcctaaccactggtacctgtgaatgtggctttctttgaaaataaggtctttgtagatatattcaaattaatataaggtcacagttgattagggtgagccctaatctaatatgactggtgtccttaagggaagagaaaacagagagactcccatgggaagatgcagagacacagacacagagggagggcagccatatgaagatgggagcagatatgggaattgtgctgccacaatgtaaggaatccctggggttacaagaggcagaaggagatgaggaaagatccttctctagagactttggagggcacatggccctgcttgtaccttgattttgggctcctatcctccagaactatgagacaatacatttgttttcagccactcagtttgtagtactttattatggcaacctgagcaaactaatgcaatattcaatgataaaaaaacaaacaaacaaaagcaattttttcatagacgatagcacatgtttcagtatctgaatatctttagtcactaacatttgtttttctacctttctcccttgaatttcatgtaaaattaactacagttcttttcatttcctttatatgtggctgaagaatgttttcattatcttgtctccaggaatgtaataatcaaatatcaacttctcatagttggtaaggatttcaaatttataaggagaataatagaaataattctagagaggctatgaaataataaaatataagaacttgagtcattgaaattaaaattaaaagtgatgaaaggaatatgagttggtatcaatgtagtttttcatatattctatatgtataattaatatgtgttttaaaaataggtatgtcttattagaactcacttttctttaaaaatggaatactttagacagtgtcattacaattaatctttgtattaagtattacacgtttttgctcaatcagttgtgaattgtgttgaaagcgattttcttctttctcaaaaaataaataatatagtgaataatttgtattttaaacatatttaagtggattcaagttatttcttcaataatgtcatcttcagtgatactcagatattctttgtgagtaaagaaagtgttttgttatatttagcaaaactgaaattcatatgggagggccttgaacctgagagtctgtgtatcacacagcagagaaaaaatagtttgagagatgcaatatttttacaatatttttctaaaaatattatctctactatttaaataatattttatgtaaatgttaaataactttgaatattgtagaactttcatggtatgtagtaatatatgcaattccatcaattgtcattgttaagaaatgttgtatattgatttattcacactataattaactttgagaaaagcagaaatgtaaagtgataacactttattgtaaaagaactaaaaaaaaaaaaaaatgcctattgatgtcaggcctctgagcccaagcctgtacgtatacatctagatggcctgaagcaactgaagaatcacaaaagaagtgaaaatgaccagttcctgccttaactgatgacattaccttgtgaaattccttctcctggctcagaagctcccccaatgagcaccttgtgacccccctccccccacccctgcctgccagagaaaaaccccctttgactgtaatttcccacaacctacgcaaatcctatgaaatggccccacctctatctccctttgctgactcttttcagactcagcctcctgcacccaggtgattgaaaattttcattgatagtgagccaagatctcactactgcactccagcctgggcgacagagtgagactccgtctccaaaaaaaaaaaaattttattgctcacacaaagcctgtttggttgtctcctcacagggacacacatgacatttggtgccaaaacctggacaggaagactccttcaggagactggtaccctgtcctcgtcatcactccgtgaggcaatccacctatgaccttgggtcctcagacccaccagcccaaggaacatctcaccaatttcatatcgggtaagcagtcttttcactttcttctccagcctctcttgctacccttcaatctccctgtccttccaattccagttctttttcctctctagtagagacaaaggagacactttgtatccgtggacccaaaactccggcgccagtcatggactcaggaagacagtcttcccttggtgtttaatcactgcagggatgcctgcctgattattcacccacactccactggtgtctgatcactgtggggacacctgccttggtcattcacccacattcccttggtggcaattcaattgtggggatgcctgctttggctgctcacccacattgcagcccagggctgctcaccactccccttctctgtgtctctaccctctcttttctctgggcttgcctccttcactatgggcaaacttccaccctccattcctccttcttctcccttagcctgtgttctcaagaacttaaaacctcttcaactcacacctgacctaaaacctaaacaccttattttcttctgcaatgccgcttgaccccagtacaaactcgacaatggttccaaaaagccagaaaacggcactttcaatttctccatcctataagatctgataattcttgttgtaaaatgggcaaatggtctgagttgcctgacgtccaggcattcttttacacattggtccctccctattctctgctcccaatgtgactagtcccaaatctttcttctttctctcctgtctgttccttcagtctccaccccaagctctgagtcttttgaatcctccttttctacggacccatctgagttctcccctcctccccaggctactcctcgccaggctgagccaggtcccaattcttcctcagcctccacttccccaccctataatccttctatcgcctcccctcatcacacccggtctggcttacagtttcgttccgcgattagccctcccccacctgcccaacaatttcctcttaaaaatgtggctggagctaaaggcatagtcaaggttaatgctcctttttctttattcgagttatttcttcaataatgtcatcttcaatgacattcagatattctttgagagtaaagaaagtattttgtttagcaaaactgaaatttgtatgagagggccttgaacctgagagtttgtgtgtcacacagcagagaaaaaatagtttgagaggtgcaatatttttacaatatttttctagaaatattatccatactatttaaataatttaagtaatcattaataactttgaatattatagaactttcatggtatgcaataatatatgcaattccatcaattgtcattgttaagaaatgttgtatattgatttattcacactataatcaactttgagaaaagcagaaacacaaaatgataacactttactgtaacagaactaaaaaaaaatgcccatcgagacatttttcagcctctatatgacttaccaaaacattagtgtatttagttttctttgtaacatctaactcttttaaagcttatttttaaagtcagaaatgtttgcttcaggaataatttctctccttactctgttttcaggcattatatgtattagtctctcaaaaccttgaaaagagaggtattctgaagaaatatgtcttttctaatatattcatatataattcattttctctcttttatatatccaaatttttattggtataggtttctttaatagggagactatacatatttccaaaaagccttaagaaattaataaaattaaggagaaattactaacaaaatttcaattttcttttaattttttgaaacaatattctacgttaaacctacataaaagtgaatcatagagaattggcataattcatatttttattttgaaatcttttattgaaaaatagaaattgtatatattcaaggcatataatgtgaagatttgatatacatagacgttgtgaaatgattgccacaaccacattagttaacacatcaacttatgctgtacattagcttccccagaatttattcgtcttatatctgaaagtttgtaccttttgggaaacacctctctattttccccatcccttagcccctgacaaacgctgttctttctattcctatgatttcaaattttttagattctacatatatatgagatcaaacagtatttgtctgtctgtgtctggttcatgtcatttagcgtattgctttcctggatcatacatattgccataaatgaaggatttttttctttttgtggatgaataatgtgcattatatgtcctcattttatttatcctttctgccatcgatggacgcttaggttgtttccatatctcggcgattgtgaaaaatgctgccaatgaccacaggagtggaaatatgtgcagatatatgagacactggtttatttatttttgcctatataaccagaattgggattacatggtaattttttaatctttttgaggagctgctacactgctttttacaatggctataccagtttacatttttaccaacattgtataagggttttcttttctccacatcttttcttacctcttgtctttctaataataaccatcctacacaggtgtgagatgatatcttactgtttcagcaattatttttttggacatgagaccaaaagcacaggcaagaaaagcaaaaataaggaagtggaacaactcaaactaaaaaacttttgcacagcaaagaaaacagtaaaattgaaaaagccacctatggaatgagagaaactatttacaaacgatgtatctgctaagcggttaataaccaaaatataaaaggagtacttatgactcaatagcaaaaaccaaataacccaattaaaaacatgatcaaaagaccagaatagacatttttccaaagaaaacatttacatggccaacaggtacatgaaaaggtgctcaatgtcatttcttctttaaatgtctgatagaatttaacaattaagtcatctgagactggtgctttccattttggaagatggttaattattgatacaatttctttaatagatattcaaatagtctatttcttcttgtataagttttatagattgtgtctttaaggaattggtccattttatctatgtgggaatactattgtttataatattcctttattattttaatgtccatgggattaattatgatactctcatttctaatattcataatttatattatttctcttttttgtttgttattttgctgggagatttatcaattttgttggccttttcaaagagttggctttctgtttcatctatttatttcctattttttatttcattggttacttctccagtgaaaaatgatcaagatacatgcagatgaggtagtgagttagtggaagagaaaattattaaagggaaatgataagattgattttctagtttaacaaatgaaatcctatttataacttctccttgctttctaagaagagtagatactgttaattggagagagtttccagagcaatatgattggtgtggggatgtaagtactagataggagctggggaacaactctttgtaataagtagagagaaattcaaagtccctccaacaaaatgcaacataaaaaggagactggagaaagcaaggccaggccacatgctacatgagcaatttgaaggaagttagaatccttggtggcagcatggctacaaagaaatttggagaaaaaaatttttaaaaggatttggagcctgctttgggctgttggaatattctatttcacacaaagttatcaataaattacacagtttactaatgtttaagatagggaacatgccgttgagttgttcatttgtgctataaaacaatttttaaaaacagtactatattttagtcaatgatatatttattgtaagaagtgtttagatgtagagttccactttatgcaacattggactaagtaatgtatacaaaccatccacatttagtttgattaatccacatttggattatagcttattgtttcattgttctatgggactctgatatttacccattttaataaataaatgtgtttttcaagcaagacaaaacaaacatctaacaataaatttaagattcatgagaggctttatcttttcatatgcattacaaaatacatttattgtgattttaagacacctggatacatgcatcttcagcttacaagatttaaaatgcagctgaaaagcaaccaaataattttttctgaaatcaggtatttttttacatgagaaatattggacatatctagaccacattcctcatattccactccatttatctactgacattacccttcctactagaatcttccattttctgaggaacttaatattgttgaggcagatactgtggttaggtttcccaaagccatttataactcctttctcttatcttcctttatacttctgactgagaaggcaaattatttgacctctcagtgtccatcatagctacagatggccatatgacatagttttggccaatgctgtgtagatacaaattctaaaagaggcttttattctcaaataaaaagacaaagttccacaaggataaggtctcttgtactttccttcctagttttggccaacaatataaatatatctagaggagcagcagttgtctggtgacctaaatgttttgatgacaacaggctaaaaattgtggctagtcaactgtaaaccaacagcaagaataatttatctgtgaaattatgtaatcttggatctctatgatgatattcaatatttagtggctaagtcaaaaccttaacatctggtaagtgcaaaaattattataaccctaatatcaaggaaggtactatgctgccattctatattaaaacaaaattaattttagctttggaataattttcctttaagctcaaccctttctaattctaaggcttctgtggttaataactctgccattttactagacaggcctcaaaaaggccagttatatcctagactatggtgaaatgggtgaactctacaaacactgagttctcacagttgaatctacaagggaccatcagttaacttaagggcagtcagtccactggttggccacctatccatggcaaccgagacaagaaatagcaattttccttcttagacatttaactagtttgatgaaaatgaaaacaagttagcaatgagaatgtaagctaagaagaagtcataggtagaaagtcaggactataagggattacaacaaatcataatttctaaaaagctgaaattctgcttcagtggaaaaattaatagtagaggttgagatatcctatcataaatttacccaaagaaggactacaaatttagctgagcctcatcaatggtggagcatggagtgaaaattttagagtcagtatttccatagattccagttttattcaggtttcatatttctctcagttcatgttgttcagctttgattgttcagtattttataaatttgcatgtccatacgtgtaatttaagattcttttggttacaaatgacttatgtaaaaatatgaatttatcgtggtacacttaggcctattatatattccattccatcaaagagttgggccaccagacaggggaaaagcaaaattttataaaactttccttaatatgctaacattaatataacacaggtcctgcaaaaccagtctatcatttagtttaaaattatttattcataggaaaaaatatttgattagtctaccttttttaggtgtaccattgatgattccttgggaagaacaaagatgtggggagtgacacccatgttaaaagagggtagtttttggagtagatggactggaaagagaatttagtatgtatgcaccacaatgttgattcttacaacttctaaattatttgagatacgttgacaagtttttttgttatttgcaaataaaagagtcaaactaccctcagcattaaatttgaggcatttacacatggtggcaataatacatcttcatatttttcaaggagttatgaaatccagaggctctccaacctgtagtctcaactgcccaatcagatttccaacttgaagattccaagaattccagagcatgttatgagtggctgaatatctggtcccaagtgaggtagctgcatgctaggctagtatgtttagataatttttctatgaactttgttaagctaattttatttgtaaataaccaagcaaaaatcatagctttttccttagaatgacagaacgagagaattatctacacatttccttatagctctaatcatcatttaattcctaacccttaattccttgagcaaattcatgcaaaatccccattctatttagttggtctcaatacctgcattttcgaaaatcttaccaggcttgttcttgagtatttaatggaatgatctgctctaggtctgtatgtactaagaagtctagatatttctcagatgcaaacacagctacttcctcggcttattgggaaggcatcttatgtgatctgtaaataaaattcaaaacgtattagaatgattaaaggagttttctttaagtaaccgaagaaaataagtttaagtaaagtgcactttgcctcataacaatgttagtaatattttataccttgttatctcattagtatgtcttatcaatgctttaaactattaattctttgttgagaggtatgtaagcagaaagtgaaattttgtaaaccctagaagaaaaattccaaagctcaaacatatgtataaaaggaaaatttattttgcttttaacatttgttatattttagaatgccaaatgctgattcggttagtcattaaaagccagaaagcttggcacgtggctcacgcctgtaatcccagcccttagggaggctgaggggggcagatcacaaggtcaggagtttgatagcagcctggccaacatggcaaaaccccgtctctactaaaagcatacagaattagctgggcatactggcaggtgcctgtgatcccagctacttgggaggctgaggcaggagaatcatttgaacccaggaggcggaggttagtgagccgagatctcgccattgcactccagtctgggcaacaggacgagactccatctcaaaaaaaaaagtcagaaaaagtgtgttctggagttagcagatctgggaatgactatgcaaatacaaagacattccaaaagagatataagccaggggttgcattcaactgagtcaaccttttcgacatgattttattgaaagatgactcaactagttattgctaagacaataacatggacagtttcccatgaagattggtgtgatactgtttggaatagagacacattaactaacttttcattagtataaagagaaaaacaaaatgcagcaaatgttctggtaagaggaattttatttctggaatattaattaaatagcagagtaatgattagaatgaagggacaactgataaagtagttcaaaataatcccttcattatggcagtttactttagaataatacgttgggtatacagctttatggaaacaaaataaacagttctcgataacataaaattatgacattaattcactgtaaaggcctcttgtagcttggaagtttataagaaagttaaacagttttcagtagtgcaggtttgtgtagataatttaataaagtagaaataatcttaagaaaaatgctttatgtatttattacaaactaaattaattaatgaaaatctttcctttagaacatttctgttgaccaatattttatctaccacattttggaacttgctctcctgtatgtattaataataaatccactgtatgaagccctgattccaagtgtggcaatatatgagttccctaatataaaggcaaagctgggattatattaaatttcgtttttgaagttattgttataagacagaatgaaacttttgtaatatttatttttctcatttagtcatttagaaataagaatttatagagttttaattttgtaatagatccaaattcttgattataattaattttcagcaataagattcacttctatttgaagtgattaaaataaaagcttctttattaagattacaaaccttaatagattcaagtactagatatgtttatttggatttgtttctaaggaattaaatgtcactgagagaacaaaggtttttttgttgttgttgttgttgttttgttttttacatacttgccacagttgagcagaacccgctaaatgaactccattaccaatgttactaatgttattttgggtactgattttaggtgattataaaataaaacagtttagagaatgtttacactattatttcctttacataattcatcttattcaaattgataattgtcctttctaacaagaaattaaattgtgcagatattattgttagaaatattggtatcgttacttacctatccacaatatcaaacatcaaaaaataataaaaccgagcacaaaaaaggcatacacattgaaaagagagaaatacagccatctttatgtatagatgaataattgtctatgcaaataatcctaataaatctacaaaaagaaaacacaaacaaataccaacctccttgaactaataagtgagttaagcaagggtgcatgttaccagatcaacatacaaagtcaatccactcctatatactggttatgagtatgtgtgaaacatttacgattgctccactgaaaatgaaaacttagttacaaatctaataaaatatgtaaagaatcctcatgctaaaattttaaaatgataatgatagaaaatttaaaaaatctaaataaacgacataataagagacatcctatattcatggattggaacatattaaatgtgtcacttcaccgaaaattggtctgtaggcttaatgcagtccttattaaaatcctagtgagttttatttagacatagacatagacaaaagcattataaaatttatatggaaaagcaaagaaactagagtagttaaaaacagttttgaaaaaggttaataaagtgggaggaatcattgtatctgctacaattgaatattactcagcaaaagaacaaactattgatcaccatgacacctttgatggatctcaaaggaattatgcggagtgaaaagagccagtctcaaaagtaacatgctgtaaaattacatttacatagtattcctgaaatgccaatattatagaaatggaaaatagaccagtgcttgacagaggtcaggatcaggagaggaagaaggtggctgtggctataacagtgtaacctgagggagctctctgatggtgttgcatgtgatggtgttggacacaaatatacacatgcaaacaattacatagaactaaatatatatgtgcccagaaatgattgaatataaaacaagtggaatctattcagtgggttttagtaatgttaatttcctgcttgtgatacgataatatagttatgcaagatgttgccactggggaacactgcatgaaggctatggagtatgctcatgctctgtattatttcttataactacatataaacctacaattctctgaaaagaaaaagtttttaaaaagagaccaggtgcagtggctcacacctgtaatttcagcactttgggaggccggggcgggtggatcatgaggtcaggagtttgagaacagctgaccaacatggtgaaaccccgtctctactaaaaatacaagaattagccaggcgtggtggcgcacacctgtaatcccagctactcaggaggctgaggcaggagaatcccttgaacccgggaggcggaggttgtagtgggctgagatcgcaccattgcgctccagcctgggcgacagagcaagactccgtctcaaaaaaaaaaaaaaaaaaagtaagaaaaagtaagaaaacattgttaatgaaatgtattttgtaaaatatgaggtccagcatggatgctattttttgcctttaatattttagttaaaaggtcctgggccgggcgcggtggctcacacctgtaatcccagcactttgggaggcagaggcaggcagatcacgaggtcaggagatcgagaccatcctggctaacacagtgaaacccattctctactaaaaatacaaaaaattagccaggcgtggtggcactcacctgtagtcccagctacttgggaggctgaggcaggagaatggcgtgaacctgggaggcggagcttgcagtgagccgagatggcgccactgcactacagcctggacaaaagagcgagactccgtctcaaaaaaaaaaaaaagtcctctaagagcagatgatattggaaaaggatttttaatagggcaaattctattatagcaatgttaaactccatctatttctagaatgaactatgcgatatcctcatttattattaagattagattatctctggcgatcacttaactatgttttcatgagtatgctgtagcctttctgataaatctgaccaaacctaagtattttatccattgctccttaaagtgggtgatctccacaggtagtttattatgtttgattgttattataatagatttcattctttatcctgttaaagttttaggtacctcacttgcccccaggtactttgatagaaatggatttcatgacagtcatatatgtattatggttatgttctcatttcattagtatttgttctatacatgtgatacagatttcccccactgtaaaacaacggagtaagaataggtattgtgtactttctttttactctttggtgaaatttaaattggtctaaaggaatgcccacattatttaatttgaaaaattttacatgttcaaatatcccttaaaatagaaagttatttaagcttacaaggttaaaataggtatttatttttccagttgcaaaattatatttagaaaatagtaaagaaaaatcactcttaagccactcattcagaaaaaaactgctgttcaccagcatggcacatgtatacatatgtaactaacctgcacaatgtgcacatgtaccctaaaacttaaagtataattaatttaaaaaaaaacaaaaaaaaaaacagaaagagaaattccagagcacaaaaaaaaaacacaaaaaaacattctaaagattaccttaatatattttacaatacttacatagtgtatgttaagtgtatgttttatgccatgtgttttatgcaccatgtatgtgtcttatgcatatgtgttttatatatacacatgtatatatgtgttttatatgtgtgttttatatatacactttatatatatacatatatctatgtatgagattttaaaaatataaatatatatatacagtagagacaaagtgtacagacattatacttgaaaatttagccctgccttaaataattaataatatactattgtttataacataaacaatatgttataaacaatagtatattattaaatattttatgattttgataaatagatcagtataaaatgatttttaggggtgtaattaatatgaaaatagcatgtatctaactaaaataattagaaatttacatggtgcccaagtgtttgctactttaaagaatattctaaggcataccattgtttatgtattcattatacagatttataagtgaaaatatttatttggaagattgttttgaattgatgcattttcttatgctttataaatactctaatattaggctgggcatggtggctcacgcctctaatcccagcaatttgggaggctgagggggtgggtcatttgaggtcaggagtttgagaccagcctgaccaacatggtgaaaccccgtctctattaaaaatacaaaaattagctgggcgtggtggcgcatgcttataatcccagctacatggaaggctgaggtaggagaatcgcttgaacctgggagatggaggttgcagtgaaccaagattccaccactgcactccagcctgggcaacagagtgagactccatctccaaaaacagaaaacaaacaaacaaaaccccccaaatactctaatattaaaacatttcaaaatctttatgttagagaattaatacatctgattataaatatattaaagtcacttttctttgtgccaaatatcttgcacaggccatggcaaagtcatgagatgatagtgaataaatgaataaatgaatgaatgaagcactcctgtctacctcattgagttctatactttcagatggctagcccttatctttaggcctcaatttcctaacacatttacaccagctctccagtccatcatttaagttagctttgcctctagtatttagtttcttctttactagtggttttctaccccacttgtatatggcttctgttattgtagcctttcagctactagtttgggataaaaaggtgatccttaaaaatacatttgaaagataacaaacataaaaccttgagaatatgtttggccaccaaatacattcttaagttccaatattttaaaattcagaacatttttacatatcaaaagactacatagaaagtaaaatttcacattgcaagcaaactttttcagtacattgcaagataaattactgcagtaaatgttagtgactcagtttcgttgttaaaatatgacaaggtaatagttgcacatgtaaatgtgaaaagattttctttcaaggtctgaaaaaaggaaataattttattcacattagttcccttcctgtttttactaccatcatttcaattcagggcttgtttctgcacaggatagagtaatggcctcctgttttccttccgttcccatttattccaccctgtgcaagactgtgaagttattctttctaaaatagaaccctgataatttaacccacctgctaaaaacaaacaaaatgaaaacagctaataactcttcactgactacagttcaaacttgtcaggctgaatttaaggcactcaatgatctggattcctccacctgcttctccagattcatttctcgttattcttttccatggatgctgcacttctgccaatctggacaccttgatgttcccttcacatattttgcatggtcctgctttatacttcttactctgtgttatttttaccttctttcgatttcttgatttccaccttttcttaaaattccgcctcattcgtaaagcttaccatcagctagctaccatttatgattgcttattgttttcgtgaatgttcattatagtttagtatattttgccttcaactaacaaacaacaaagtcaaataataagaaaattatacaaattatactttgtataaagtattttattactgtatctatcaaggaaaccactgtattgtaagcaccttgaagtcaggttttgtgctttgctttgttttgttttcctgctttgtgttctctcacctccaccgctcttataactatcatattatattgcacaaagtatatgtagagtaagtgtttgagaaattgaatagagccaccagaaatagttaaattgagctatttcagtttgcgtcggaataagggctaacattttctttctcagtatagtggtttactaaatttaaaatgtgttgtgaattttaaagtttggtaggtgacatgtctctgaacagagcactgtggccttgggttcacattggcatttggagctggctaaacctacacatgccagagtgtactttcccgcctgctgttccagctgaggctttaatgttggacttttaagctgagccaaacaggtaggggaaacgattgccagctatctgatactgtagagatttaggccagatggaaacttgctttaaaaatcaaaccagtttcagtcataccaacatgagctttcttggatgtctgctttggagacattatgttattatcatcatcatcatcatcatcatcatcatcattattactaaagtcagaagtcactaaaatattgtattacattttcaaaaatacctgggaggtggatacaagaatgtcatggtaaaaatactgatcctggactagaaggagtagaaaataataattgtaacttgtgttattttccctcaatgatctaaaatctggaggtgaaattctttaaaagtacatcataaaggcagctaggagaactgatgtggtagctccaaatggctattttgttagaggtagtaaaactttttcaatgtaagtgaaatgatccagcaatcagttcctccaggacttttcctgaatgtttacttttaaagaacatttataccttctgtagaatgtaaagggaggatggacacatgatactcagaatagtcaagtcactttacaagaaaaaagacaagaagcaggctgataggaagtatgaaaatactgggaagtccttaatggtcagacaatataaattacgaaaaccacagatagctgatacccagccattcaacagaacccattaagacatgattatggagtcatagtcaaggactcagtttgactgaatgggagctttataaatttttaaactactatcttcttaattattgcattagcctacttgaatgtgagagaaattatctttttcttatcacaaacatctactgggaaaacacctgctaaatttcaatagtctgcaattttaatgtaccataatgtagtactattatgtccaacaatgactgtttcctcttatgcagttatgcagatgttgcaataaatgatcaacattggactatactgtgtctaatgtccaagagtaatagaagtaaagacagtcgatactccttaattatgaagcaagctgtttaaaatttcaagacatttctgatcaaccacataaggcaaacttccaatttattactcctgcattttgaatcagaactctggagcaattcaatgcaagaagaaaactatctggattttctcccttctccccatatcttttaaatttatgcataattataattatcttcctcctttagtgtcttcattaataaattaccacaaatgttatttcaattttcaacatttgctaataaaaaagacagttttagttcagagagagtataactgctcattatataaacaggattatatttaatacgcaataatgttctttgttattgataacaattactcagagatcctgtaagcataatgaactctgtaagtaagagtggattgttttattctctcaggaacttaaattcattcatttattttctcatcattaagtatttattttgtagctattatatgtcaggcattatctcagatgatagaaaaacaaggaagattaatactgaattcttatctctcaggagcttaccatctcaaataaggtggcaatcatgttaataaagtctgtatgagggagaaggaagccaaaggaaagagtttaagagttttgacagcatttaagagacacaaataaatagagtcagttttcttttttatgctgttttttttcccccacacttaaaaaaaaattctcacatccgtttcacaacttcttgacttgagaaaactctacagcagttttatggaagcatttatgaggagctgaaagggtacagtgtaggatttcacatgtggggatacacagagtggaataaatatatttcatgggctatacctcagagttgcaagaaaactaatgtaaagttattaatgctagaaaaattcaaaatatattaagcaaaatacctattaacttacaataggacctttttttttgtagccaccagaatactagatgctccctcctacccctcaaatcactgtgctcctaaaaatagagcatctgaaaggccaacttggcaatgaggtgaacagatacagtgaatatggaaatatcagggagaggtgagcagtcattaggtatattttatccaggcaacaactaaactttatatattgtttatgcctcagaatagaagattcttctttaatgttcttcatttattctttgttagaagaataaatttctgttcatgatatacagatttacatttcttatggacacaggttaaaataatagatcatacaatctctggcttcttttttctaattaatactggatccttcttcccagtatcttgtgctcttgaagaacatagcagatatgttcataaagagtctatatggaaaagaatgaggccaaagtaatgaattttaatgagaaagtttcgtacaaacaaataatagtactgttctgatgaaccttcttatcgtaacatatttttttcttcagacaggttgcaatataactgctactgattataaacattatccatttctagaattgattaagctacagcattgttcttttgttatgattaggctaaagctggtgataactgagactgctttagttactctgatggaagttttctctttacctattttctctctgttcttttagggtgaatcatttccgtaagtggcttattacatttggtagcaattattcttgatttcatttttcagtttgtcaaagttctaggaataccttactttgttaaataggttttatgacaatcatgtcttttatattgacactgctctcatttcatttacactttatgcatgcagtgtgcatatgcataccatagtggaactagctttagttggaggacattttgcatgctttcctgctgttcgttggcacaatttaaattggtacattaactaaagagtaggcattggagtaagtgttatttgagtgacatggcatctaataaactctgaattgcttatagtagatgtaagggcaatgcctgcttctgcccttaacacactgtcaaaacttgggcaagttcctgcaattgtccacgtttaagtatttttgtctgtaaaagagcctaacttgtctccaagctacctctggatagctaccttctagtatctcagaggtcatttagagcagtaataatgtataaaaatgtcctgtggtgggagaaatatttgaaatatttattctatataaagattataaaaattcaagggggcaggggaaatgcataaggaagaacaaagccaattaaaaatccccctgttaaccactttatgagtgttagagtaaataagtaccagagctccactgagataaacaggaaggacaaggaaattttcagaaagctcacacacacacacacacacacacacacacacagagagagagagagagactgagagagtaagagagacaagctgtccataagtaatgatcttctaacaaagaataaatgaagaacaggccagtgatgattagtacataatattcagcaaatgagaaatgattggaaaattttcttctgctcatgtgggatacagcagcttagaacatactactgctcttcatgccttctctgagaagatgattaagggcctggtaatgtttagtcacacaaatttatccccaaaaggttacctgccaacatactaataatgatttctccattggataatccacaaaactatggtaaaaatttatgaaatactcttcctttgttctgaggcgaaaagaagtgaatggacaagcacactatatgccactgctttacaaataaattgcctttcattttaagtgactggatatcgtaagtgatagatttagacataatttatagtagagagaactaggaagacttttttttttttttactcttggattctgttgagttctagaagtattaggtagaagcattcatggatttcctggagagacaacagctatgggactcccaacttaaccagagatatgagtgacgggaagacgcaaaggtcaggccgagcatagatacatacaaggtataaaaatgaagaaaaacttcttggtgttttggctctttggggtagtttcttgggtagggcttctaccaccacagctctggttgaactttaggccctatgtgtcagctgttctctctgcttttacctttctactgcttactcagtgaacattccagaatagcaatatactgttacatttggataaatattttatccaaagtacaaaatggaatgaatatactactaaacactggcgttaggttattaaatttataacatgttttaaaaattatactacaacaaataactcatttaagacatctattgtctgaagaaaagtcttcaattgtaaggtcaaaatcattttgtttaatgcaaagaaatctagtcatgatcagagataaatgtaaagtcatacaagagaaaacaattgtttactcagcttttgttcaaattatcttatgggttttattacagtaatttgtatacagaacatttatagatttgacttagaacagacttctccatacattcaaaaaatgtacaattccactaaaacttgtattggtcaactttatccctaattagaagaaaagtagtgaaatatacaataattctaatattatttctgctctctagattgtgttagtctctaatattgagtgaggtcatcagtgtttgaggtttacaatatacagaatggaacagatgacatgatacttgaataggcattggtttaaaaaaaataatatattagtgtttgagaatatgtttccaaaggaatgtgtaccaaaatgtgtttctagagtggaaaatccctcagttggtcactctatatttagaaatatatttgacaatgtttttgtcagtaatgctttgactcaagctgagtcaaaattcgtttcatttttagaggacatgaagaacaaaataaatatagctgattacataaagcagggtttccctagtccagaaagcctaaggattacagagaggctgataattgtctacactgtgtgtgcacctgcactgaggagagaaaggtgtgaatataacaagtgcctgggtattatacaataactgaaaacccatgtccaggtaaagagaaatccaaataaacatctggatcggtttacatgcagacatgctgctaatataagtaagtttctatcgtttatcaactgagagttaaaagtagctattaacatttggatacattcataagatttagaccttgttatccctcgaattagtcatattggtaaagtgaaagcataaacattttatggctttctcttatatctttgattgaatgagatagaaaataagtgttataagatgtatagagtaagtctatgagaagggtagcacaagtccctgcaattctcccttttacaacttagcaactacctgatccaaggcatcactgttctccactggagcactgcatttgccacctgattgtaggctccctccatcaatgactccttctactccatactccagacagcagcaagggtgagactccttgagtggaagagtgaagccctccataaatccatttcaaaaagaaacaaaaatactggcaaaattgtcagaatcagaactctgctcctacttcatagaaagctatggcaaaagggcctttgtagatgtgattaaggtaagtaccttaaaatgaagagaatatcctagattatgcaacataatcatgagtctctaaaagtagagaacctttctgggctctggtcaaagaaatgtgacagtagaagaaagacatgaagatatgcaaactcactgctgaatttgaagatggaggaagaggaccatgagccaagtaatgtatactgcctctgagaatcaggggaaagatgcaaagaaatggattttcccctagggccttcaggaaagaatgtggccctgctgacaccttcattgtagccaagtgagactgctgatagacttctgaaatgcagaactgtaagataacacatctgtcgcttttaaacctgataaatttctggtaatttgtcatggcagcaatagaaattgaatatattcatgtaaccacctttgacttctttacctctgtctgatttattcttcagatatctaataatttgctttaaagcactttcttcaattcatttttcaggtagccttgcctcagtgagaccctccctagccattgtgtctaaagttgtaaccccttcacttccaccccaaacagtttctaggctgatattctgttttatttgtctctttagcactaatctctattcctaatatatgatgtatttactttattaattttgtttactgcctgtctccacttctagaaggtagctccatgagagtagcattttcatccctttttttcttcacaactttacctccagcatgtagacatgagtctactatgttgtattcttaaactatgtttaatgaataaatgagtgtaaagtagatgtagctgctttttcatgagacaagccatacttatatactcatttacttatagtttttgtcagtctcttctggggtgttagattcataagtgcataataatttgtcgtcttctcagctacaagtgtctcaaatgagaattactttaaaataccagaggaagagactctttaaaatgctaatattctctttataaaaatacaaacatgcacaaccattggaatatagttttcagataattcatggacacgctgaagcccattcttaagatccatactggtgtatctattagaaacatataattcctaccatagtgaacattgtaaatgcgtggcatcacttttgagaacttgaaaataaaatccttattacaactgataattgaacacagggttaaatgaatattaatagatctgtgagacatggaaagccctcttttcacaaacataaagaaatgtatgtgtgcattgaccaaggaaataagagaatcatttttgccttatatgaatgctaaaaccattttaatagtttttcttttcctgatggtagtttaataaagctttctttttataaattaacacttatctctgtacttttttcacttactaaataaattgaaatgcataaaatgttatagaaaatatactcacttgaaaatgtcattattgtctaattatgaaataaaattgaaaaatattttgtaacttccagcagtaattaaaatttttgctacatatcagacaacagacagaccaatggcacctacaactttatcaaattttaaaagctcaatagaaaagtctgtgaaatatgtaaatttgcttagatttgcttccttacagacaaaaattcataggacaacagtaatttgaatgtaagaaaaatggtaaaaattaatttatccacagttattatttaattcttactaaagtcaattaaaagagtcacaattccctcactgaacgatatttgctatctgtttaaacatatgagaagagatactaatgcatacacaaagtgcagtttacagctatccctgaagatatcttagtaaaaagactcttggctgcatatatccaatagttattaattctactattgttacccacattagccagacattatagtgccttctctctgacatgacactgtgtcaggcactttacatatataaagtgaatattattagtccccattttacagatcagaaactggagcttatttagttttaaaaatgtgtccaaatttatatagctgggagtggtagagctgagatttaagagctactgtccttaccactctcttattgccaggacctcctggttatttccacagatgacttctattgtttttctccttagttgatcttgttataatggactttgtcttctaaactgcttttcttagattacatttttcccatttggtattaatcagacataaaccagagccaatcaaggcttctgatgagcatgacttcaagggtgctgatatgttatcattggttacaatccaaaagatttgatattgtaatcattgtgtgtgtgcagtgttttttaggacaagtataccttcccttgggcttttccaaataatggagcctgagagtccccactactttcatggcccccttgatgtgtagaaacctcaggcttgtaatacccaaactatcacaaatgctaaatgtaatcaatgttgcttttatgctatggatttggagtctaagagacaaaaacctcccacccaactgttacaaccctgtccaaccctcaagttattatttctgtgcttgccatgtatcagaccctgggctaaatattaggactataataatcagcacatgagatccctgttatcaggacgcttaaacacaaatgtgggtgagagtctcaaatcaaatatgacacaaaatatacaattgtacatacttatgtaccattaaggaacgatctcagacagtagacaatataggtacctaccctaatctgtcagttcagctaagtcttccctaaacaggataagttaactgagggtgcagggaaatccaggagagggactggcagtctcaagttctgaggctggagcagactttgacatctgagaaagtgaaaaaagagcagcatagctaaaatacagaaagcaaaggggaaagtggcataagatgaagtaagagaggtcagaagggccttataggctagtttaagataaatctaatttaaagcaagagcaatagaaagccacagaatggttttacacagggcaatgacctaatcatatttgcatttttataaaaacaccatttccttgtctttgaaaatgtggtgtgttttttttttttccgagtagataaaaagagaatttgaccaaaaacatttgatcgaacacaacccagtcactttaagacaaaggagagtattggttagtgagtattaatcactcctaccattggttggttcaaaatgaatttcaacttttaacattccagaaaaatgtgaataaacatgtccttgtaaatttgcataattacaagtatattccaagtatcatgagagaatttctaatttaagtacaatgccatctatgtttggtactgcatttctgagtaggatgttttttgcacatttcccataatgaatttcagagctttggttgagatcttgttctcgtattgttttccagtcatatgataacatcactgaaagttttactcatcaggaaaatatgttgcactatttgaagaggcagagggacaaggatagacatgaacatatcctgatgcaatcattaatttttctttcaagaaacccttgtttaatattgaatatgtatcaacagggtgagatgaaaaaagaatagttcttcctctttctctttctccttatactcttgtttttcttattcagaaaggaaaggacaaacatggttccttagaagaaactgtaattttattccaaaacatttcatatcatctaaaattgtgaaaactatcaccagaagcaagaaatacttggtagattttgccagtctaatgaattaattcactgtgaagtttatggttatattaattttatgtatgaaaaaaaggaggtttgaagatcattaattagtgcataattcaaaagaggaaaggttgtagggccagtgctcaccccttatgagtatctactgaaaagctgtgtgcctaacaaaagcttgagtgtcaagggactccaggtgaagacagtctcaggtgagtccagacaagtaattctcagccctggatgcatattagagtcatcaggaagttttataacataccagcagtggggatggtcaatatataagcttctctgggtttgaccaagagaatcactaactttaagactctccccatacttccaaaaatgcagttagatttgagaatccctggttcagacaaggattctttattttaattcaatcttcctctaccttcatcacctcacttttccaattgttttatttcctgtagtcattatttcctttaaagctaaaccttacagaagttttggacaaagaaacaaaggagagagaacaattcgttggatgctgagtgctattatttacaattctttttcaaaagctttattaaagtataactaatatacaaaaaatgcaaatatttactgtacacatttggatttcacctttttttgttgttcaacctattgtcactagacttgccatctcaccctggattactgaaactttcttccagtttctttatttctctcattaatattatatattaactatgcagttatattcaagtagacttttacctgccagtgtactggtaaaaaaaaaaaaaaacagcatggtttaaatttgtgtactgcaactgcttctctgctttcaaaacctgtccttatatattttatactgtcactattgccccagtgtcacagactcagctccaaccttcctgctcattcttatcatggaggatttccttttatgcttccttccctgttgccttgatgggcctatcatcctcatttgcctttctctttctaaaacccctctcaattcctatcttctctatgaagctgctattattgcagcccacactgactgcttcctttttggaggtactaattttgtgtattacatcacaagaattagaactttattgttttctaatagttttataaatattgggcccttcatactttgttttatactttttgacagcagaaatcaagttgtatatttttaagttatgtcctccacatcttctttgaacttccaaactccataaatacttaatgctaataaatataatccatgcccttttgtaatgcatcgtacttattcatgtaactttttctggagtcctaaaatcttccttagggatacttctgtgtttgtctcattcttgcatacttctaagggtattttcattatactatattgtaatggtctatttgtccacttcctatatctgctagattgtgtgctttttgtggacggaagaaatgtcttatgtgttccctgtcactttaatgagttgcttttcttatgtccttgcaatgattcacgtatgcattcctctatataccttcatcatcttctacgtcttccatcacaacacttaatataaatacaactttaacatctctttcacacaatacattgtaacacaatgcttctcaaccaaggatgtttttgaaccctgggggacatttggtaaagcctggagacatgttttgtagtcaaaactgagattctattgtcatctaatgagtagaaaccagggatgctgctaagtgttctttaatgcacaggacagagcctccccattacaaataattatcccacccaaaatatcagtagtgacaacactgataaattttggtgtaaactcagggaacaagcactatgttcatggatatatggctagcactcagaactattcctgccacataatagatattcaagaacacttgtgtaattgaacaatgaagcctaagcagctcaactgagtcctctgaaaaaaatagcataccatgcttattttatccctccatcaatccatccattgattcacatgtacatgttgatcacttcccatgtgtgacgcaggccaggcatgggatgaggcaataggtatgcattggagactatatatatttgtgtgtttgtgtgtgtgtgtatgtcttacactcaaagttcttctatataataataaatacagataagaggcaatttcacaacactgtatgtacactgataatgggttttctgaggccagcacaaaagaagatcatcaaattcaaacttggggatcaccaagggttgagttttaaagccaagatttgcaggataaataaaagttaacaaaaaggggaactagagaaagactatacacaaaggattagaggcaaaaagtctttccatattcctagaattgtaagcaattggggataggtcaagtacagaatacaacagaatcctaaaaaaatgaaagatttggaaggataagaagtttggactttttatatgattagaatcatataattctaatagcattatacaattttaagcagttattataaaataacatatatgtaaggtattactgttatttttgttcttactgctaatgtcattactagtctttgaaaaaagattggggagaggacaagaaaattgaaaataatataaaaattcttaatgacatttatttaaaatgaaatattcagtcatccttaaataatgttaagtgtcattttactttgtctgtttctcttctacttctgtattttatgcagttatgtctatttttaaagaaaactggagctgcctataatgctttattggacaaataatacttcactgtgaaacctttccccaaccacagcctccacgagagcatccaacaatgaaaaatggtaagtatgataatctaatctaatttgattatatcttatcaatggaggtggaagtcaaaaatagaggtaggtgctgcaggattcaggtagtagaatgaaaagtttaaggcaggagttatttacaaaggctctgctgattctttctaggtcactgtaaaagaaaaagatgagcttttctttaaagtccagaagtggaaactacaagatggaaaagtgttctgatcctttttttgaggactttcatttaatttcatttctggtgttatgaaagctgaccgtttcatttctggtgttataaaatctgctgtccctagcagttttacccttctgttggttttccaccttcctaactcatattttcagatggacaaaaatgcaatcatacattactttttgcataccacttcaaagtttaccaaatgttttgatctgcattttcttagcaaaatgttagagggttggttttcaccaagtttcacttactcaccatcttattttctttagtatagaacttcacattgtgaaaaagagagaaaaagaagatcagtgcaattcaaataatcagcaattactcaggaattcttacctttatcaaagtactcattgccaaaaattatatttggtttttaattatgtatataaaaatacataacaggatttagtcataaggacagctttttattatttgccccatcttttggccttcatgatgggcatacttttaaaactaagagctcaaaacaaatttgtttttctatctgttcatcaataagataatctatcattcatatgtatctgttaagacaggtgaggcctgtagcattattttttaagcaagaaataaattattttggttttaagtgaaaatacttcatgctagtaatgaaacaaagcaaataaattgtgagtggtattttcttagtgaaatgggagtatttttctgattaattatttggaatctgtaatagagaaacatattgttttgaaaaataattgcacaggtgaaagcaataacaaaatcttcattagaaaggcaaggggaactagcagcagaggaaaactaaagaaattcattgtgcttgagactaacctatttaagaaggagaaattgctgacacatctcttcaagaggatcatatctcatatatttggaggatgaaagaatttgcagctaaaggaattagctttaggctgtatttaaatctcacaaacagtctcaatgccatgtgtacaattgcaatatcttgtccaaagtacatatttttttcccaatttttgagaatacaattttatactttgagtataattttctcttttatgtattttttcaaataaactttatattttagaaaaaatgttgatatacagaaaagttgtgctattagtccacagtgtaggattctcatatacccacactgtttccccacttgttaaaattttatattagcatcttaattttgttgcaattgatgaaatgacattgatacatttttattgactaaagtccatactctttattcagattcccttagtttcaaacctaatgtcctttttctttttccagaatcatatccgggataccacaatacatttagttgtcatgtctccttgtctccttaggtgctgcttgactgtgacagtttcttttctttttctttttgtttgtttgtcgagatggagtcttgctctgttgcccaggctggagtggagtgcagtggcacaatttcagctcactgcaacctctgcctcccaggttcaagcaattctcctgcctcagcctcccaagtagctggggttacaggcaccaaccaccatgcccagctaattttaaaaatatttttagcagagatggggtttcaccatgttggtctcaaactcctgacctcaggtgatctgccgccttggcctcccaaagtgctgggattacaggtgtgagccactgcacctggccgatggtgacaatttcttatactttccttgttgttgatggctttaacagttttgaagagtataagtgaggtattttgtagaatgtctttcaatttggatttcgctgatgttttccttatgattagattggggcttgtggatttgggggatgaagaccacacaggtaaaataccatttttgtcatagcgtagcaaaggtatatactatcattgtgacttactttgaacacctggttgaggtagtgtttgtcaagtttgtccattgttaagcttttctttgtttctctctttccattctgttccttttggaaagaagtcactatacacagcccatacttaagtgaaaattacactttattttcttgagggcagaatgtctagataaattattgggaattcttctgtatgggagatttctattcatccaaaataaaaaattattcaatcatttatttgtatcagtagggactcaggtgtttatttactactatgggttataatccaatactacttcatttattttcttgctcaaattgctttagccattgacagctctttcagttggctcttgtgttcctttggcataatcccatcatcgtgtttaaattttttctttgtaaatttttgagcacttctttactttatggcaatataaggtaccataatctcatttttaagttttctgcccctgttgtagaaccagccatttctccaaagagcctggttgcttttgcttttattggagaatggtgttagaaaccaaactctaggcatgaggggttctcatggctactagagtgttgttgcctccagcctttctcagctgacagaacaaaggaatacatgtgtatatacatgtagctataaatatatatataaaccatctgtgtattaagctaaacatattaataagtctgtagtaatgtcttcaattccagtccattaccacataaatcgttctaccctcttctctttgcttacttgtaatcttctgctctaaaagtgaaacacctggcttctatcatctaccatttatttactaattgttcaattttagtatatatgtatagttctgtcattgtttaacacatacccccgtgaagattaaatctgtcagctcacatattatccatatatacaatttattttgcctttagccatacagattccagttatatgcaaagtttttcagttcagcacttttttctccacccctttcagtggggttctttcatatatttgtaatacagtcagattgttttatcacagcctacattccatcctacaatactttgacctcctaaatattttctaaaatttgcatacattaagattctaacttctcaggtagcctgcaggtttttttcttttctttaatttgttacccatatagttctgtttatccagagtggttttttcccactcactgtttacttagcaagatcctattcattcttcaggtcacacttatttcagtattttagaaaagggtttccttgacacatcactataaaatacttcttttttaggtccttccatatattcctggcatttttctagattttttttcttctatacactgctaaatgaaaatttccattccaattatacacaaaaatacaaatgaaaagctatacattttcttttaaatattcactttaaactttgaagttgttgcccaaccttactatctgtttatctattttaactcagagtgagggcttctcagtgttacaaaatccaattatttctctatttgttaaatctttttgaaattttgatcaccaagaccagtaaatgcttctgggaatactatccaaggctacgtttgtatacaaaaaagtcaagataaaatattcagtcaagaggtccagtgaacttttttcagagattttatgtactaagtttaatggtttaaaaataaaacattagcacttgacagaattacatcactacaaataaaaggaagaaatcactttctttggcttttagatcaagctaataggttttagtaatacttatgaatcttattcttctgattttaactttgagatttttcccttacttttttatgagaagaaagactacatttaatgcagcagcaagaggagggatatatcctgaatctgagtgataaaatcacatccataaaattcaagactgctgatgtagggacaaagtttatctcaccccttccatttcatagtcacattttgtgtccagttttgtatagcatctctccttcaaatgtgatggggtagtctgatgttaacttcagccgcatatgatgaagatagattcctctcatgatttttccaatctttttcctacttgtagaacatcccactaattagatgaaaaagtgttgttttgctgacaactcaaggaaggacagaaagtgattttcaatgcatctcactttgattggcatacacatttggtggtaaaatcttgttgctttttttatggttccccctagattctcttcccatgtcaccctcagcactgtcttagatgtcatttactctagaactatttctgttactatcacttcacaagatagtttttcaatactgttctttttaaacatgccccttcaatataccctcgtttctactgtcaaaagtattctagcatgagttatttttaacatattacaaccaccctaacacctggaagtttatctctagcttcccatttcactatacattcagttccagcttcttattttaagatcaaagtcctgctaccaaatgatatgtatttcttcccctttactttctatttccaaacaattttctgaacctatttccaggaaacctattgtcactttttctctactctcattttgaatttttcccataccaaaacaatgtcatatgcctggggttatgttcctgtaaacacaaccagagtccctgaatctttatctttctctctctctcagtctctttttccctctctcagtctctttctccttcctgaaatagtgtctaacatttcacctatttcagaaaacctttctagattgattacaaaatctttctagattgatggatggaggggtcctcctgaattggaaggatgttcaaatattggtgtttaaaaatccacacatttgtacattacagtagctttctacctttttgtcattgttttaaattgtggcctaggaaataggaaacatatttttattactcttgtatgataacttgccaagtttaggcatgattttgcatttttggacatgctattaaggttatcattgcttcattgtgaatgcatctattcacagtgtaagaggaaattttccattgtgagttatcatttaatggtgatatgaatacaacgatttaagcttcttaaacattttaaaataagatgtgtatactatgaaaatgtcatttggtttcaaatctttgtcttatctttggtgtcttattgattagaaggtcaaaataggactcgtaaatttacgtatcatatattagcttaattacatgtttctaatgtacaatctgctggattttattggcagggtatatcacaacttttaatgagccacatcttgcaccagtccacactttgaaacagaaagaaagcaagtaattaaatcaggtttcctacatttaaacacattggactgattagatactttggtttaattttctgggaaaagatagaaagttttaaattgaattagttatttacattgtgtttttcatttatgtgaagggtaaatttattatggatattaaaaagaaacttagcatgtctttgcctttaagcaaaatatatgaatgtttgcatcatatagaaattgactgcatatgtgcatgtatgtgtatttttaaaattattgaattccccagatatttaattaaaaatgcatatacatttatatattcattagattctcaaagagggtctgatcagaaaaaattcacaataatatatttattttagtcacttattttccttttttactacttaataattttaataaagtggtaagtcacctagttattaaaaaacaatattttgcatttgtatacaaatgtataaaataatatctgtatactatcaccatatttatttattttcttaaaatttatttggtggaagatgaggtaaaaatgcatgtgtaaactgtacatttatagtttacatatatattgtttgtaagttcatcaagatatttatatatatatatatggggttaaaatgttaataatgcagtctaaacttaaaaatgtgtaagttctgtagattttacaatgtaaatagaatatttaaaatggaagggatatttttccagtattcaaaactattgcccaattaagcaaagtagtcattcacattactgacaaacacagaaaaatattagcccaaactgttcatcattactgaaaaaaataacacagaatacatgttttattgatatgaataacttattactccaaaattactgctctaaaataatacttgtttcctttttaagtctttctgtatatcaactgctctttatatgtgatctacttttatatttacgtgtaattatatatgtacttacacatttaaagacaattcacacatttaaagagccatcttcttcccagttccactgaccattattaagatttttaagtttttacttacataattattgactgctttctttactgtattatcttggttgggttctctactgaaacatacactccaagtacatatcgcttttctaccagatcgtcttcaggctagagttgggaaattccttaaagaaccaaaaaagcaaacacacacacattcacactgaacagtatttgtaactgtgatatttatttaaaaattcacaatagtccataggaatgatttataattcatttggtgtattaaaattttatttaaccttcaacaggtgaaactcaagcttcgaaatgtagaaatctgtagtgaacatgtttcaactgaggataatttggagcagggccagtggggattttattttatggtggtggcaagagaggagagtctggtggcaggcaatgagtatccagctgtgttggcaaagttcaaatattcgcagccccagtggtgatagctgtgagcgtccatctggacaatggccaagtgctatgcaatctgtgtttggctctggacaccgctttgtattccagccttcctactggttctctcgtttccctatgacattcctacatttatgcataggttaactaaggtcagaatttggtttacttttttcatttaatatcaaaaaacattgatttgattaattgctatattttcacatttagggcaactaacatcccatgccagatgagagttttctcttatattggccactactattctgcctctcaagattcctattcattctcctttctgtcatataaaaattaattttaaattaaacaatgggatcttgaactgaatatggagattcattgggattctatatctgtgagatataaaagcatagtgagtctctggacaatgaaacacctttgccatatatggttatccaaaggaaggggcaatattattttccaagctgtaccaaaaacatatgttcttctctaaaaaagagaatagttagaatcaacattttgattgacaactaggcataaaaggagttagttctgtattaaagtctttctgttctttagtacagctcaacttttaaaaactttataatatcctcatcatataactatttcatgtccactgttctaaatattaatgacattgaaaactaaccatttgtgataaacaaatgtttcctgagacaaaagagactttactactattacataaaagtttagtgagcatttgcaaatcgtcaactatattcaagataatactcctgtttatgttcagattcaaataatcaatccttttaactagtaaattaggcattttgttccaattatttgtttagtttaaacagctgcaagtctttaataaaataattatttgtaataggaacctgatgagctggaatatcagaatgtgccattattagttgtagacattaactctctttttgtctaataagtaagggagtggacttattctcttaacagagagagcttgatgactggatgaaatgtcgaatttccattttcaaatgagcagtttctaaggtaggaaaaaaatattgcacaatctaaccatattctttggtattaaacacatctcctgagaacattgagagaaaagaccatatttgctaaaaatgtataattcaaagctgggaatgttcattaaatagagttaaggatattatccccaggtagaaggagcaaataagaacatggatgagagaaaagcctggattctgcagtaaaatagaaggaggacaatcccagagggaaagaaataatagctatgttttaattgctcaggggacagtggttagtggggtctgtaggtgactttggattggagatttcatttgacccggaccctgatggaaataggtaatagtaattaacactttaacactttgcagtggttacaatgggctaggtattattctatgatatagctagatgatagatagatagatagatagatagatagatagatagatagatacacacacatacatgtgtatgtatgtgtgtatacatacatgtgtatatatgtgtatatatatatacacatccatatatgtgtgtgtgtgtatatatatatatatatatatatgtccagtcacttaatgctcacaacaattctatgagtttggtcctattagtattcttaatatacaaatgaagaaattaaggtaacaagacattaagaaacttacacaagaacatacagctccaacagctagtcatatagactggcttcagcaccagtacctttcattctacagcccattctcagatcaattgctctacccgcagctctgctaaaggggtggactttacaggtaatgtttctgaattattaaactctgcttctgtttcatgccttgagagggaggtaaggaggtgaacaaagaatagtaatttggagctttgtgcaaatattcaagctgagccagtgagattccctcttatgagtgggaattaaagaatgcacagagagtaggccagtgagcagcagagattgcagctcaattgtcatggtatagagaagaatctgaagaggccctggtggccatgggcagaaaataaaaataggctcaggaatctggctggcagagaaagaattgagagaacacagtagagcaatggggagccagagacaccatgagagagaagtagacagagcagctcatcccattccaggcagcatgtgtctttataattaatacaagagagaatttgagagtatatatgtttctgtgtaactcttatcattagttatatcgttgggagcaactgggagttttcaaacagaaggataaagtgatctggcagatgatacagtataaaaagacagcagaggatgcagattggaaagggaaaaactaagagcaagatgttcactatagaaggttatggctatagttgagataaaagagtaatttcattaaaaatggatcagaaaatgattatgaagacttatctgacttcgttctcatgccaacttattcattcactcatttgctcatagattcctagaaataagttcttgacaaactattctcctcttgtctttctcgttataagcactatccttaaagtcaacaaatttcaaatttttttgtcaacatacatttactactatgccagtttctgggaacactaagataaacatctaagttcttatcttcagtgagtacatacactgtctagtgaagatgtatagactattaacaaacaggaacagattattcatagaaggggcaacattcccaaactaacaaaatgtggaaaacttttaaaaggagatgatactgaattagaagctggaggataagttgtctaacattctgaaattcgttgacttcgaggatagtgcttataatgagaaaaacagcaggagaaaagtttatcaagaatttctttctaggaatctatgtgaaaatttgttgagatgggggaggtagatgacgtggaacaccaataaactattttcttaacttttcttttatttatttatttattattattatactttaagttttagggtacatgtgcacaatgtgcaggttagttacatatgtatacatgtgccatgctggtgtgctgcacccactaactcatcatctagcattaggtatatctcccaatgccatccctcccccctccccccaccccacaacagtccccatagtgtgatgttccccttcctgtgtccatgtgttctcattgttcaattccaacctatgagtgagaatatgtggtgtttggttttttgtccttgcgacagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatagctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcagttctctgatggccagtgatggtgagcattttttcatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagataagtaggttgcaaaaattttctccaattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatgactagccagttttcccagcaccatttattaaacagggaatcctttccccattgcttgtttttgtcaggtttgtcaaagatcagatagttgtagatatgtggcgttatttctgagggctctattctgttccattgatctatatctctgttttggtaccagtaccatgctgttttggttactgtagccttgtagtatagtttgaagtcaggtagtgtgatgcctccagctttgttcttttggcttaggattgacttggcgatgtgggctctttgttggttccctatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatatgcaaacagggacaatttgacttcctcttttcctaattgaataccctttatttccttctcctgcctgattgccctggccagaacttccaacactatgttgaataggagtagtgagagagggcatccctgtcttgtgccagttttcaaagggaatgcttccagtttttgcccattcagtatgatattggctgtgggtttgtcatagatagctcttattattttgaaatatgtcccatcaatacctgatttattgagagtttttagcatgaagggttgttgaattttgtcaaaggccttttctgcatctattgagataatcatatggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattgtcttttttggttgtgtctctgcccggctttggtatcagaatgatgctggcctcataaaatgagttagggaggattccctctttttctattgattggaatagtttcagaaggaatggtaccagttcctccttgtacctctggtagaattcagctgtgaatccattccgtcctggactctttttggttggtaagctattgattattgccacaatttcagctcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttataagtcttgctagcggtctatcaattttgttgatcctttcaaaaaaccagctcctggattcattaattttttgaagggttttttgtgtctctatttcctttagttctgctctgattttagttaattcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatttatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgctttttttgttttccatttgcttggtagatcttcctccatccttttattttgagcctatgtgtgtctctgcacgtgagatgggtttcccgaatacagcacactgatgggtcttgactctttatccaatttgccagtctgtgtcttttaattggagcatttagtccatttacatttaaagttaatattgttatgtatgaatttgatcctgtcattatgatgttagctggttattttgcttgttagttgatgcagtttcttcctagtctggatggtctttacattttggcatgattttgcagcggctggtaccggttgttcctttccatgtttagtgcttccttcaggagctcttgtaaggcaggcctggtggtgacaaaatctctcagcatctgcttgtctgtaaggtattttatttctccttcacttatgaagcttagtttggctggatatgaaattctgggttgaaaattcttttctttaagaatgttgaagattggcccccactctcttctggcttgtagggtttctgccgagagatccactggaagtctgatgggcttccctttgagtgtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaccttcccttctcgcttcatttcattcatttcatcttccattgctgataccctttcttccagttgatcgcgtcggctcctgaggcttctgcattcttcacgtagttctcgagccttggttttcagctccatcagctcctttaagcacttctctgtattggttattctagttatacattcttctaaatttttttcaaagttttcagcttctttgcctttggtttgaatgtcctcccatagctcagagtaatttgatcgtctgaagccttcttctctcagctcctcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaagagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccgggtctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgggcttcctggctgctttgtttacctaagcaagcctgggcaatggcgggcgcccctcccccagcctcgctgccgccttgcagtttgatctcagactgctgtgctagcaatcagcgagattccatgggcgtaggaccctccgagccaggtgtgagatataatctcgtggttcgccgttttttaagccggtctgaaaagcgcaatattcgggtgggagtgacccgattttccaggtgcgtccgtcacccctttctttgactcggaaagggaactccctgacccctcgcgcttcccaagtgaggcaatgcctcgccctgcttcggctcgcgcacggtgcgcgcacccactgacctgcacccactgtctggcactccctagtgagatgaacccggtacctcagatggtaatgcagaaatcacccgtcttctgcgtcgctcatctttaattttcatattaagttttcatatgaagttgtcctttctgacaataattagccaatagttttatttgtttttatatttattcttgctttttgataataaataaaaccagcaatatgtaatacttgtgttgtctacttattataggatattagtctaaaatagattgtggattttttagatatgttaaaaccaatggtagagctaatttattcactataccatataataaaaacattttatctgccagaaacttctttgtctgtggcttagaggaatattatagtacaggctttgttgatacaataatagcatatgatctgtagcaagattgtatatgctggaacacagtcagaatctatttgtggaatcaaggcaggatcaatgagctcagcaaagagcttattctattattagtcattttcttgataagatgagagagaggttagacacagtggtggcataattgtgtctaaaatctacttgcttctcatgaaagattttaaattgagtgatttattctaataagctgtaaagaaagaagcttaaatataaatatgaaggtgagataactcataaaagtataatctacggagatgagtgtttattttcatgaaaataaattagactatattttgagactatcttaaaactgctagactactttaaggatgactggaattcgtctttcagaggaagatagaaaaaattataatggtaagagttccttcatttggccatttcagattaaggagattatgcattttacagtagataaagttgttggaatctaaaaatataagaaattcagggagatcttccaaaaaccataaatttgaggggaatacttcactaatacagcagttttcattgttagaatttccaaatggaacatttgctctggagacagaatccaaagattccctttcaaatctattatgttagaatttgttttaattattttgaattgcttaaaaattactttaaaatcattttattcagtttcataatgttttcttcttgatatttaagctttatgatagtttaaggagcttatgaaaacatggatacatttggaattaagtatgacataaggaattatctaattcagcattaacttaggtaaatttgggatcttcagttcatttgccaaaggatgtgtactcctctaaggtaaatgaaaaaccaatgtccaggcaacagaaatatgctacattatccagatatacctctgagttagctacttttggaggattaacaaatttttttcaccttttggggagagaggatatgtgagaatttgttagttttataaaggtgttagcatatttcagctaagaaaatggtggagtctccatagtaacttctgttttaggcaaagattatatttaaaatatttcacataatgtcctgaggaatcagaaagctcacactgagcgaagagttcatagacagtgatctgggctacaaacagacctcagaaatattgcagattcagttctagaccactgcaataaagtgaacattgcaataaagaaatccacacaaattttttggttttccagtgcatataaaagttatgcttacccggccgggcgcggtggctcatgcctgtaatcccagcacttcgggaggccaaggcgggcagatcacgaggccaggagatcaagaccatcctggctaacacggtgaaaccccgtctctactaaaaatacaaaaaaattagctgggcgtggtggcgggcgcctgtagtcccagctactcgggaggctgaggcaggagaatggcgtgaacccgggaggtggagcttgcagtgagccaagatcgcaccactgcactccagcctgggcaacagagcgagactccatctcaaaaaaaaaaaaaaaaaaaaaaaaaagttatgcttaccctatactatagtttttaaagtatgcaataccattatatctagaacacaaaagtacatatcttaattaaaaatattttattgttataaaatgctatcaatcatctgagctttcagtatcatactctttttgctggcagagggttttgcttttatgttgatggttgctgactgatcagggtgctggttgctgaaggttggtgtggctgtggaaacttaaaatagcacattgaaatttgccaggtcaattaggttcttattttcatgaaagatttctttctggtacatgatgctgtttgacagcattttacccacagtagaacttcttttaaaattagagtcagtcctctcaaaccctgctactgctttatcaaacaaatttatagaacatactaaattccttgttgttattttaacaatgttcacagcatcttcactgggagtagagctatccaaagaaaccactttctttgctcattcataagaagcaactcttcatccattcaaggtgaacacttagagacacgaaatgagcatatgctgttggaaaaatggtaggggtagatgtgctcaacaaagtcttcccacaagaagcacaataaaacaaggtaggcctgtaatgccctgtagtatgaccctggcttgctttcttgcatcaatattgcaattttaaaactaaaacaattttaagaaagcattctaagagataacatctcagttttcttcgtggatcttaccttcttgaggcaatggtaggagtaaccctgagctatatagattccaagaggcagaggaactgatggagggacccttaaggaatctagaaactccatggagagtattattttgttgctagaaactgcagtgtgtttgtgattttcaaccacaaacacatgctgtctgggctcaggacctcagaggtaggtgtaggaaactttaataatatattaaactactttggagagctccagaatccttccacttattcagtttctgatatgagtcaagaatacaactgaggctgggcacggtgggtcacacctgtaatcccagcactttgggaggccgaggcggcggatcacgaggtcaggagatcgagaccatactggctaacacggtgaaaccccgtctctactaaaaatacaaaaaattagccgggcgaggtggcgggcgcctgtagtcctagctattcgggaggctgaggcaagggaatggcgtgaaccccagggggcggagcctgcagtgagccgagatcacgccactgcactccagcctgggcgacagcgagactctgtctcaaaaaaaaaaaaaaaaaaaaaaaaatacaactgagccaggttctggggttttgaacttggagtaggggagacaaataactaaaaagcactattgttctcatggggtatcctctttagagcctctttttttcagcgtcccccaatttatatggctactaatattgtttggttctgcgtccccacccaaatctcatgttgaattgtaatcctcacgtgtcagtggaggggcctggtgggaggtgattggatcctgggggcagatttcccccatgttgttctcgtgatagtgagttctcacgagatttggtggtttaaaagtgtggcacttcccccttcactcgcttgcactctctcctgctcccacatgtgaagatgtgctcacttccccttcaccttctgccataattgtaagtttcctgaggcctccccagccatgcagactttgagtcaattaaacatattttctttatgaattacccagtctcaggtagttattcatagctgtgtgagaatgaactaatacagctactcttccatatcctgtggttcctgcattaataatccttctctcagaagaaaagaacccagaactccctatccctcacctcaccccttgcattagaacacatggaatgaagctggggcctaagagtaggttaatagagagcacactgctgcacctgcttccaatcaacaggcacgtgagactcctaactccttataggttgtctctctcagctcaccagaatttccggagcccaagagctgtgctcgtttagactgaaggagaaaaagcaggaattagggttatgactaaaatccctttttatatgagatattaaaggaatgtcatcttttctcttttttctcttattttaccccagatagttaacataaacctttctgctctgacaaagatttactactctgataagtgcattttacttttaatctaaaatgtttcttaatgaaataactgactagtgtcagaatgaagacactttaggttttattgctatatcttgatttatctacttctagctgtgacattgattgatgtttataaaatccctaagcctctactggcaactatgctctttatcttagagcatataatcaaagaggtgtgggtaaaattacgtaggaagaaaaaatttcttgactttaaagaaaaaattgtgttaataatggcgatttatatgcaagggaaacatttgagcaaacagaatttttttctctgatgttttaaaccccaaactttgttttaatattttttccttttgctttctagcctgccagttggctacgtgggtatatcttagtatccatgttattgttagcacaatcatagatcactatttgattgactctgttattccacatggcaatagctgtgtgattgtagccttgtattaagaatctagtcattttatattcttagaagttctgagataaagcattgaaaggtcggctaagcatcaatcatttaaaaagttgatagttgcattagtggtattcttaatagagtgttcttttgaagacacacttgtgatcatataccacctagatattaaaagcacagctattggataaatgtactgacaatgaaattccaacagctataaaaatataagccccttatcaacagccaaataaactaaattatgttctcggttaggtcatttgttttcctgttcattcattccagaatttggagccaagtatctgaataacattgcaacagagccatacaattatagtcagtaataacattcttaagataattaggtgaaaatctatttgtggtaagttgtaacaaagcataattatactgaattttaggataggtagaatataaacttaaagttttctattctctttcaaattgatgtgataacaaataggagaggcaacttgaagttctggtttatagttaggacctgtttgccagttaagcctggacttgagttatgccctggttgtaaactccctcctctccaagcctcatttaaaagtattggagtaactctgggaagtcctgtgaaaaactgggcaaagcgatgaactctgatccatacttacttctgataaccaggttaccccaagatggtcagaatattctgctcttcaacgagaaaaatacctagtttctatcgaataataatcacttgataactattggttctatattcatttccacttttccttattctgaggacttatttctttacttcaatttagctctggaaagagaaggaagagccatcttaaattaccactcttggcaacttttctggacaattaataactacatggtaaatttcaaatgccatacatcaagaatcctgaaaactggagctaacccaaagtcctgtagtttggactctggaggccactaagataactgatggtgttacttttataaaactccctctcaagcagccagtcatgaatcaggaagatgggaatgtcaggctaccaggacgttcaagtctgccagattaccagataagttgagccataaagaggaaaaaaatccacacattaggggatagaaaagatagtttataagccaggaacatgtaaaaccacagatgatatcgacaacttctcagagagtggtagcagaaaactacatgttgttagagtcaggaaattgttggagatatgaaaaggaggcagaacagtacagcatagaataaattttgcaggtagttatttgcctgcattttatattctttttattttttctgcagtcttctgtacttcctataggatgccaattgtgtatgctcccagattctatgggatatctcattttgctagactgccaggatttgaatcttggcatggcaaattattagttgtataacccctattcaagagtcttaaatagttttatatagaaacttaaggtactttgtttccttctctgtgaaatgggtaaaatgataatgtgtccctcatagagtaattataggtgttaagtgaataattaatcaggtaaataatttggaatagtgcctggctcatcataagtttccaataagtggtggctatcattaatatttattattgctgttaatagctccactaaaggataggtattcattgacacatcatgaattaatattaaaaatgtttaccagtcctgtattatttaccaaaaatattgttttgcttactctgtaatgatgaaagtgatcaccattaagaaaatttggtgattcatttaaaaagtatttattgagtatctattaagaaatacattatgaaaaatgtggaaggaagattttaaaaaatgaataaataagaaacaatgctcaaagacattatttcttgcaatttaagagccaatcattattattttaaacaaaagctactagtgagaagtgttctataaaataaatacagagaaactttctttcagatagtgtaatatcagaaaaacaagtttcataacaaggagggtatattctcaaaaatgtatagatttttccgatttatgttgtgcaaaatatttcacagatttcaagatttgtattttgtcagtttctaggggtcgcttaataatgatgtggattcattaaggagaaatcaaagtcacccatagaggtaagttaaaagtcttaaaaataagtcctatgagaaaagctaaaagattgagattattgagttggaagaactgatactatagtatgaattaaaaagtaagcaaagattccttcaacagagatgatagccagtcgttgacttcactgaggattcaacaagaaatcagaccttgaacagggatctgtacataaaaaaagttcagtgagcaaagtaagttcactgacagcagtatggaggatttgggtcatatctctgacagtgatttcttttaaacactgaagagactggaagtactttcagcttagaactgataaattcatcaacaattagaatgtttacagttggcaataactaaaaagccagcttgaacttgcccaatttactggctcttgtaacagaagcagatcatgcaaagcctgatctagtggctcaatgatgtcactaaaagcctcatttctatctctgtgatttaccttaaaagatactggcttcattttaggtggagaccaatgcttctagggctacagttttgtctagttatactcagggtagaaggaaacaggaaaaagaagtcttgattggattaacccaagtaacttgctccaaaaatggagctgagaagattcagtttcccttctccaatagaaagaaacctagaacccttaggaaagagttagagtcaatgccaacaaaatactaacaaatgctccaaccaggtcctattatgcagaaatgaattttaatttttgttcagtagttttagtaaaattgtatgtaatttaaaaaagagaattagataaacccctactcttgctgcaaaggtatattaatgtactctatgattgaactctaaacctgtgacaagctaaagggtttaatggaaatctgaaagatactatcaggagacctggggtctagccctgtctccagtacttgctaatagtcaaaattcaccaagtcatctattttttcattccattctaaaatgaatatcagcttttgccttttctccttaccaaatagtatttatcaagtgaggtaatacatgagaaatactttgtaaactatatcattctatctaaaattaagaaatattgttgttctaactaaacattagaattttgccattgtctagtctaaagattaccttgaaatgtattttttaagagcttgctgcactaataatatagcttgtcaaggttttatttcctatgagttgttggagacattcacttccataaatgaactccacatgtagttactaaatgtattgtgctactgttagttttttaaataaatttataattattaataaaaaccacactggccgggcgcggtggctcacgcttgtaatcccagcactttgggaggccgaggcgggcggatcacgaggtcagcatcaagaccatcctggctaacacggtgaagccctatctgtactaaaaatacaaaaaattagccgggcatggtggcgggtgcccgtggtcccagctactcgggaagctgaggcaggagaatggcgcgaacccaggaggcggggctagcagctggccgagatcgtgccactgcactccagcctgagcaacagagcaagactccgtctcaaaaaaatgaaaataaaaataaataaataaaaaataaaaaccacactgtatatttcctctttagaagggattttagtgcctattcttgcatcttgttactttcgttctttgtgttaggtttaaaatatagcacaatgggaaaggttagaggtaggactcttcttcaataaaggtttttccataattcagagcttaagaaatgaaccagtgtcattgtctaactgaagttcaataccaaataattcacagaaaggtaatgagccattttagactgctatttgaatacaatctagttatataaagccatataatttgtattacaatatatttccatcatttcaaattttagtttgaaaaatttgctttttaaaatcattttaggcattataatttataaagtattaatttaaaggattattcttagaactgttactggattattcttagaactgttactggcagttgttaaaaatggaccaagcctagatttctatttgtctctgcttacctatgccccattacctcaatatcttatccccccaattcaggtgatgttaaaaatatgtcctttatattatgcaattatgctttaaaaagttagaaattattatgtttctatttgacattcaccactctgtattagctcatttcaaaaagacaaatgctagaattcattccttctttatgccttaacctttatttttaaatgtgcaagatattgtactaaatgagtgtagatattaaattttataagaatcattcctacctttctggctttcaaatcagcatagatataagacacaattattttcaagatatgtgataagagtggtagcaagcacaggggaagtgaggacaaactctgaggaagcaggcattgtttccatttttaacacatgagaaagagctcttgcagacagtagatgtttatctgggcagattcatatgtggcaatctgagtggaaagtgtattctcaactgagaggaggttatgagcaccttcagaggcaggaagatatgttgaatgtcggtgtggactcaccaactggtcaccagctggtttaatttggccttcagggatattttgtttgttctcaatcataattaaaattctttagaattattgccaacattaaaaagcaggaaagttctctgtttccagtttcttatgaaaacgtgaagatttatctacattccatattctgacattcttacagcctcacacaacaattatttagagctgagaagctgctgcttcactcaaagggagaaatcacctttcttctctaaaacaaagggtttcttctttcatttaggttacttgattcagttctgtaattgacttagttgtccctagccaggattacaaggttaattctgtgtgatggagtctgatgtctttgttttagaaagtatttgaacttgtaaaatatattgaaaataatatatgttccatgaagaaaaatatcttgaattcattgctatatggagattaaagatgaagttttctttagatttaattgaatttgtattttaatttatattgtgttcattaacactaataatcaaaatggaaccttgtttttttaagctccattgttaaacataatttaattagtcagaaaacatttttaggatgtcaacaattttagatttgagataatatttaaccagtttggtacatttcatactcttgattggttgaccaaatatgtgtttaatgtgaagatattgggtaagctatgcttttataatccaaaatttgaatgttataaaaggaaaatggggagtttcacatatcttcaaatattttcacgccaaaacaaaacgaaatgaaacaaaaataccactatttttctcttatttctcagcatcaggagaccagaaagaaatttagacacaattaatctctttcaggattaaaaaaaaaatagaaaagaaaacaaactgtggggagttggcctgcatttgatcgattttgtcttgtggatagactctgacgagattatcttgcctgctgtttctttaaatgtgcaacagtgaaggatcatgaagagcagcatgggctaaatctaatggattggtaaccaaatgttaactccacagacatgattaataaatatttaacgggtaaaaataagtgaatgtaataatacattgaagccaataagttctactgctggcttagagattatcaagacagagtttaagtaaaaatgttctactcagtattctttcctttttttctccttcctttcttcctttcctttcttttaaatatttgtagaaaattaagtttctctgtaattctcatagttaatgtagggcagtgtttgttttgtttgtttttgtttttgttttgagacggagtctcgctccatcgcccaggccggagtgcagtggcgccatctcagctcactgcgacctccacctcccgggttcaagcgattctcctgcctcagcttcctgagtagctgggattacaggtgcccaccaccacgtccggctaatttttgtattttttttttttttttttttttgagacggagtttcactcttgttgcccagactggagtgcaatggcgcgatctcagctcacagcaacctccgcctcccaggttcaagccattctcctgcctcagcctccggagtagctgggattacaggcatgcaccaccatgcccggctaattttgtatttttagtagagacgggtttctccatgttggtcaggctggtgtcgaactctggacctcaggtgatccgcccgccttggcctcccaaagtgctgggattacaggcgtgagccaccgcgcctggcctgtatttttaatacggaaagaatttcaccatgttggccaggcttgtctcgaactcctgaccccaagggatctgcccaccttggcctcctaaagtgttgcaattacaggcgtgagccaccgcaccgggccagggcagtgttttacatactactcttacaaaaccaaatttgctttaattagaaactaaacctttcatcttacaatatgtaagttaagttcttctaaagttcaaatgtgtatttagatcttgattttcacatgtatttgatgtgtaatctcaggaacaactacttagaataaatttcaaattagtaatatataataatcaactctgcaattagtaatttgtttagctatttataactcataatgtactgtaactcacaatattagctgttcttttcaatgcttaaccagaaaaagtagttatttattctaaataaataagccccttttttagtataaaattcaatgccatgcagatgtcactgcctactcttaagttgttccacgattctcataaattatgtatttaatttgcccaccaggtcattgttgagatgttctctgtaattagtgaagatatttaatatccttagattttttcaatgttgaaaaagctattatttagtattttctgtgtgtcagatatttttctaatcattttacatgaattacttttaaaataatctctaaaactttatgattaatttacctttactaactatgtacatggggaaaaagaaacatggagaatttaacttgtttgatagggacaaacagtaagtagtggaacaggatttaattccaggtgatcttcacctctaaattctgctagtgcagactagaatgatctcctcaatcgtatgctagtgtagatgaggttgacatgctttttctttctcagaagtactaaaaatccaaatgttatgctgagctaactctgcaaagcaatttttaatattctctgtccttaacagtggtgtgtgaaggactcataatacacgtcttttctgatgtgccctctgctacgggttagcaggaaatgttagattattctagaaataggtcacagttgaaagcaataaagaaacattctttagttctaaattatgcctattgccataactgaggcgcaagagaggacaagacacttgaccacagccagataagtaataagtggtggaccactggcatgtttcccgtaattttgagaagactctgggaggtttataacagcccagtaagggaatccaagagacctccaacatcagactttctaacatctgagatggtataaaggatgctcagcagcctgcctgaagaattttgaatatactgcatgatagaggcaacactttgaaatggccagtgacaggatcaatcaggacacctgtactttcagcaggcagaggggtcaccctgagccagccacataactacgcatttttatagacagatcctcacatattagttgactctccttcctttcaacactgttcccaaaatggcacaagtgaattctgaatgaggaaaggactatagtatttgaaataatagtgagtgagaaattttcacaattaatggcacataccaaaccagatttagcaagctcagaaaacccaaggagaataaatacttcaaaccaacaaactaaaaaacaacaaaaattcaactaaggatttttttttttttttagagtcttgctctgtcaaccaagatggagtgcggtggcatgatcacggctcactgcagcctagacctcctgggtctcaggtgatcctcccacatcagcctcctgagcagctgtgcaccaccagacctggctaattttgttttgttttgttttttgttttttgtttgtttgtttgtttgttttttggtagagatgggttttttccatgtttcccaagtcttaatctcctgggctcaagcaatctgcctgccttggtctcccaaactgctgggattgtgagtgtgacccatcacacctagcaaaaaaaaaaaaaaatcatatttacactgtaaaagacaaagtcttgaaaagaaaattatatccagtgaaagtatcctccaaaaccaaagaagaaatactttcttatacaagcaaaacctgtggaaatgcatcacttgcagatgctgcctgaaagaaacgctaaaagttcttcaggcagaaggaaaatgatactggtcagaaacttggaactacatatagaaagagagagtatcacaaaagaaataaaggtaaaataaaattgtgtatttttcttattttttattgctctaaaagatagctgtttgaagctgtaatagtagcaacatatagctaattacagtgtatggataaacatgacataagtatggataagacagacagcaatgtcaccaggtcgagagagaggactgagaatactgttatgagattcccacactacacaagacatggtatagtattctttgaaggtgagttcaaattattttaaagtgtgctgtaaagcttagggaaactactaaaaatatttttaaaggattataaatgatacagcaagaaggaagataaaattgaatcatatagaatgttcaattaaaactagagaaagcataaaatgtgagggggaaaaaaagaaaaagtagttgtaggtatcattttacattcccaccaatctgttatgagaggtccagtggcaccacatccttgccaatactaggaatgatcagtcttttgaaattgagatactgtattaggtgagtggctcattgagcttttattttttctttgatgtctagtgatattttaggattatttcatgtgcttgtttaccatttatatttcttttgtgaaatgtatgtttagagcttctctcttcattaaaagttatttccttatcgttgagttttggaagttccttatatatttgtagatataaggcctttattagatctggatttgcaaatattttctctaaatctgtggcttatatttccaatccattaataacatttttggaaaaacagaagctcttaattttgttgaatttaccaatgttttcttcttttatgcattatgtttttggtgttgtgacaaagacatttttgctaaaaccaagattacattttgttctatcagtccattttatggactttcaattctattccacttttctatcttgacaccaaaaccaccatgccttcattactctaccttgaaaatatatctctacatcagccatttaagttctccatttttttcccaaagttatcttggtccttctaaggttttttttgtgttttgaattttcatttgaatttttttaacttttattttaagttcagggatacatgaataggtttgttatataggtaagttgcatgttatgggatttggtgtacagatttcatcacccaagtaataaccatagtagccaatggtagttttttgatcctcaccctcctcctactctccaacctcaagtaggccctggtgactgttcccttttttgtgtccatatgtactcaatatttagcttccatttataagtaagaacatacagtatttggttttctcttcttgtgttatttcacttaggataatagcctccagctccattcatgttgcttcaaaggacatgatcttacgctcttttatggctgcacagtattccatggtgtatatgtaccatgttctctttatccagtccaccattgataggcttttaggttgattccatgtctttgctattgtgactagtgctgcaatgagcacatatgtgtgtatatctttaagacagaaaaatttatattccctcgggtatacactcaataatgggattgctgggtcaattggtaattcttttttaaattctttgagaaatcatcaaactgccttccacaatggctgaactaatttacactcccaccagcagtgcataaacattcctttttctccacagtctcactagcatcttttattttttgactttttaataatagctattctgactagtgtgaggtagtatctcactgtggttttgatttgcatttctctatttatgagtgatgtcgagcattttttcacatgctcattggccacatgaatggcttcttttgaaaagtgtctgttcatgtccattgcccactttttaatggggttatttgttgtttgcttttaaatttgtttaagttctttacagattttggatattagacctttgtcagatgcatagcttaaacatattttctcccattctgtaggttgtctgtttactctgatgatagtttcttttgctgtgcagaagctctatcgtttaattaggtcccagtagttattttttgtttttgttgcaattgcttttggcatctttgtcatgcagtctttgtcaggtcctatgtccagaatggtatttcctaggttgtcttccagggataaaaaccctataaaaaagtttttggttttatatttaagtctttagtgcacttgagttaatttttgcacatggcacaaggaaggagtcctcatcagttttctgcctatggctagcaaattatcccagcaccatttattgaatagggagttctttccccattgcttgctttgtcaattttgttgaagatcagatggttgtagatatgtggcactattttagtgttctctattctttttcattggtttatgtgtctgttttcacatcagtgccatcatgtgttggttactgcagtcttgtagtatagttcgaagtagggtaatgcctccagctttgttctttctgtttaggattgccttggctatttgggctcttgtttggtttcatatgaattttaaattaaatttaaattttaaaatagttatttttttctaattctgtgaagaatgtcattggtagtttgacagaaatagcatgtaatccgtagattgctttgggcagtgtggccattttgacaatattgattcttcctatccatgagcatggaatgtttttctatttcttgatgtcgctgattcctttgagcagtgttttataattctcattgtagagatctttcacctccttggtttgctgtattgctaggtattttattctaattatggctattgtgaatgggattatgttcttgatttgactctcagcttgaatgttgctggtgtataggaatgctaccaatttttgaacattgattttgtatcctgaaactttgcttaagttgtgtattagatgaaagagcttttggatagagatggtggggtttcctaggtataaattatatcatctctgaagagagagagagtgattttctctctttctatttggatgccttttatatctttctcttgcctggttgctctagctagtacttccagtactatgttgaataggagtgatgagagtgaggatccttgtcttatgctgattttcaaggggaatgtttccagcttttgcccattcagtatgatgttggctgtggatttttcatagatggctcttattattatggagcatgtttcttcagtgcctagtttgttgagggtttttaacgtgaaaaccttttctgcacctattaagaagatcatgtggtttttatttttagttctgtttatgtggtgaataatatttattgatttccatatgttgaaacaaccttgcatctcaggataaagcctacttgatcatggttgattagctttttgatatgctgctagattcagtttgctagtgttttgttgagtatttttgcatctatgttcattaaggatattggcctgaagcttatttttttgtgtgtgtctctgtcaggttttggaatcaggatgatgctggcttcatagtatgagttatgaagcagtctctcttactccatttttggagttgtttcaggaggaatgataccagctcttccttataagaaattagaatttggccgtaaatccacatggtactgagctttttctgattggtaggctttttattactgattcaatttcaaaatttattattggtgtgtttaggaattcagtctcttcctggtttaatttctgaagactgcattaatatgtttccagaaatttatccatttcttcttggttttctagattttgtgcatagagatgtttgtaatagtcttcgagggttttttgcatttctgtggggtgaatggtaatgtcgcctttgttattcctgattgtgtttatttggatcttctctttatttattagtctagctagtgacatgtgttgcttattaattctttcaaggaactagctcttggatttgttgatcttttgtacgtttttttgcatcttcatttccttcagttcagctctgattttggttatttcttgtcttctgctagctttgggattagtttgctcttaattctctagttcttccggttatgatgttaagttgttaatttgagatctttctaactttttgatgtgggagtttaacactgttttggctgtgtcccagagatgctgcacttaacactgctttggcatgttctagagattctggtatgttgtatcttttttcttattagtttcagagaattttttggtttctgccttaatttcactatttactcagaagtcattcaggatcaaggttgtttaatttttatttaattgtatggttttgagcaatttccttaacattgattcctatttttattgcactgttgtctgagaatgtggttggtatgatttcaggtttttttgaatttgctgagagttatttaatgctcaattgtgtggtcgattttagagtatgtgccatatgcagatgacaagaacgtaaattctgttgtttttaagtggagagttctgtagatgtctattaggtccttttcatcaagtgttgggttaaggtcccgaatatctttgttagttttctgccttgatgagctgtctaatactgtcaatggggtgttaaagtctcccactatcatcgtgtggttatctaaatctcttcacacatctctaagaacttgcttgataaatctgggtgctccagtgttgaatgcatttatatttaggatagttaggtcttcttgttgaatttagtcctttcccattgatgtggtttgtccgtgctgtgtctccgcccaaattgcatcttgaattgtagttcccataatcctcatgtgtcatgggcgggacctggtgggaggtaatgagatcatgggggtgatggttttataaagggcttttccctctgctcagctctcattctctctcttgctgccctgtgaagaggtgccttctgtcatgattgtaagtttcctgaggcctccccagccatgcagaactgtgagtcaattaaacctcttttctttataaattacccagttccaggtatttcttcatagcagcatgagaacggtctaatacaaccattatataatgcccctttttgtcttttctgatctttgttgaggtctgttttttctgaaattagaatagcaatccttgcttttccctgttgtctatttgcttggtagatttttctccatcccattactttgagccaatggttgtcactgcatgtaagatgggtctcttaaaaagagcatactgatgggtttcactacagccttgaagaatataatgactgtgtctcagggatggtcttcttgtgtagtattttgcagggattctctgcatttcttgaatttgaatgttggactttccagcaaggttgggaaaattttcatggatgatatcttgaaatatgttttccaagttgcttggtttccttccctctctctcaggcatgccagtgagttgtacataggtctctctagataatctcatatttctcagaggttttgtttattcctctttattgttttttcttatttttctcttactgagttatttcagagagccagtcttcaagatctgcaaatctttcctcagcttgattagcattagttctaatgctaatacttgtgattgcattattaaatttatatagtgctttttagctctctcagattgattgggttctttcttacaatagccagtttgtctgtcagctcctgtatcattttattttatgtcttagattcctgggattggattttgacttactcctgtatgttgataatctttcttcttatccatattctgaattctatttctgtcattccaaccatctcagcttggttaagaactatttctggggaactagtatggtcatttggaggtaagccgacactctagcttttcaagatgccagagttcttgccctagctctttctcatcttcgtgagctgatgttccttcaatctttgaggttgttgagctttggatggctttttttttgtaaatcctatttgatgtccttgaaggtttgattgtggtgtaaggtgagttcagttgactcgctttatttctggaggaatttagtggggaaaggatcagttcaggactcctggactgcatgctctaactctgggtggtgggtattgggtcctagcttggttctatcaccccagagcctagaaacctgctgtgctgaaggggccaaggttccctgaccactggtcacaacattccaatgggtagtgctaaccaaagcactttacggtgaggttggcaacaggatccattctcattttcacctgccaacagtagtggtagtgctcagtggcagtgcagtggggtgctggtaggtgcaagagtgctgacctctgtgcaggtgctcacagcagccacaggtgtcagcatggtgcaggggttcagggggccccagcagtatctgtgtgcatgttcacagttgcagtggtgttagcatggaggcaaggcattgatggacatgggactgtgtgtgccatctgtgaatgtgtttatgtgattggcagatgccactcagggtgggagtgggtccagtgctcccccatgtagttttgtactggcagcagtgttggcactgggcaaagtgctggcaggcatgggactggcagtctctatgcctgcaaacactctgatgggaatggtggcttagtggggagctgggagagtagggtgccctcatgccagcaacagtggcatggcgaggtgcacatgcacacatgagctggcaggtaaggggaagaaaggttcacccatgcacacatgtgccggcaaagcaatgtagggggtggctgccggcgagtacatgtaggcaaagagcatggtggagattctggtgtgggagggcactggctggtgtgcatgtctggtggctgctcggctggagctctctagtggtcaagtaaggactgccagtgcaggagctatgatgtgggcccccaggaagcaccccatctgggcattcgaggctgcactgcaggacaagggccctgggagagatgagcagactaaagggtgctcatgttggactgcacctgtctcatcagcaggactgccttgcactgttcaggtcatacagtttgactatggctatagtctattagagaacgaaagtaggccttggaagatatgcttctctggctgtgctccactacagaccctctggcaccaaatcctctgggctctgtacaggctggagttttgactctgaaacttctcaaggcagctcttcctgccagctcaagcatccaggggggttgtagggtctcctgctgccagaattccagaggcctgtggccagagcaggtggctctttgcctactcaccccttctccaggagtccttgggggctaggaaggagtcccagagtgtagtagccccatgcaaggttcccagcatcctcccccttcagcccagcatttgtgtcttcccttcatccactctcaatgcctttcctctgaagatctgctaggagtgcaccagtctgcccaatgtcctggtcccttggtggcagatgttactcccaactgcacctagtcagccatcttaccccgttctctcccatttgaattttagaagcagaatcttaatttatttttaaaaatctactgagatttttattgtgattacactgaatgtatcaatcaattttggaagaattaatttcttaatattgagtattttgattcatgaacatagtagatttttgtaaggattatcagtttatatatgatttatatagacttctacgcgtctaatcagaggggttttatatgtctagttttctaattttttaatgtgaagtcataggactttgatttaattttttgggcttattttctatgaggaaatatcataacttttaggaattcataccagatattcaatatttatgcaaaatactaaatatcaaaattattgagtgctttttttggtctggcttctagtcatattgtttgatattgacttttaattttgtgttgtttgcctcctcacttggtttagtaaaataagcacagacttgagtgaaaagaggtaatttagaatcttgggtcatctacttattactctatgtaggctaactttcctagcaccaaaataaaggtatagacatattcccctagaaaagttaaaagcactaaattagatataactgagactgcatccccgaagctctagcatgtaagagacactccatagacatgtttctgtgcatttgtattttagctttattctctttttaaacatttgataacttttttcctgatagtgaaaatctactaaaatcatgatttaaatatagtaatcatccttctttcttcacacctctcaaatttaactgttatattgagtaccgattcttttaagtttaaaattatttttaaatatgaagcaaaatttatcacaggattaatccctggaaaacttttctttaaattagtcataactacttgtcataacaattgtatgactaagagcacaaaagtaattgtgtttgatcaatattttttccattactgaattcaagtcatcaatgccttaaaatatatacttgtatgatacacagaatcactgggcaagagagagaaagggcactactacgtaacaggcatgaaaagcccaagtgctgataactcataaaaactttcctttttctcagttagtcatcatgtaagtgtagctttctttataaaaaaaaatttgatcgtgttattagaataaagttggcaacttgctgatataacatggactgcactggcgtttatattctgcatagtcatttctagaaaagtgattaaaacagtgattgaattaaaattttatttcagctggctttattgcaataaaaagtcactatatttcctcttattacttttttacctaactcatttttagatgaatatacaggaatttgtattaaaacaagaccgtactattgaaatagtaagaaaataaagtgaaaaacttggagaatgacaaccaattctgaaataaaatactgtaggtattatgatgaaaaatttgccctgaagttattttgctaaggcacaaataaactacgatgagaaaatatcaagttcttgaaactttgtttgcttgactgagaattaaatctctatatttgttccagggtaaaaattaagtctctggactctgtctatattaaaatatggattgacattaattatttaataattcaaagtttcagaaatgctaaacatattgtacagtctcatttctaacatcaaactaggacataccgacagtggtttgttcttatagtcgtgtttccaatagtactccttttcttttttaaataataagacaaaggaaacttatttccttgtataattggtaaatttgatttttttttttgtctttataaacaacctgcgtgttgcttatgttatcatccatgacagtagtgggtcagaaaacaattttttaaagtcttgtcttgaaattggcttttcttctgaggtaacagtggtttgaattacagcataatttttccatagctattttatttcagtactgtttgcagaaaaaaatacttttgagtgggaaaaagaaaatgaccatagatttgattgggaaataatacctaagaaggctaagagaaaccagaaaaaaaatcattgtgttccaaggattagaaaatgttcaaagaatataagacaaaataagtataatactgtccataactcttaactgatcaatgtgacagttggtccgtatatcttccatatctgtaagcccagagacaacatgtactcagtgaaagctacgtatcaatggtcacgtttggaaattttcagcttttcttaataaattaaaacctaaggcctcataggctgacactaaaagtgtaatcttcttgtacagagatggtgaatgatgcaactcctctgttctcaaattgtccttttggaatttcttattgccagcaccactgtcaagtttatctcagtgtagttctccccttaaacaatcaggcttggccctttccatctcaatataatttacaaaagtaaagtatcagtcagagctgaaacattttcattcacacaacttcaaccgcaggaatggggtaatatgactgcacctggtaccttaagtacacatgttatctgaagcaatgcctatggagagcatgaaaacacgtgggtgttcttttaaaaatacgaaatactggccgagcaccgtggctcacgcctgtaatcccaacactttgggaggccgaggtgggcggatcacctgaggtcaggagttctagaccagcctggccaacatggtgaaacccatctctactaaaaatataaaaattagtggggcgtggtggtgggcacctgtaatcccagctactcaggaggctgaggcaggagaattgcttgaacctgggagacggagcttgtagtgagcagagattgtgccactgcactccagcgtgggagacagggtgagacaaacaacaacaacaacaacgaaacttaaatgtacaagaaataatttttaaattttaaaggtgagaatttttgactagatatagggctgggttcttaatttactagtacgtaaataatattctaagttatttcagttgcataaaattggttattggctctattttaagagagctaacaaaatctctctagttcaactatgctatataattatattaatacagtatgatagaatgaaatatttttataaagagttttatagagaagtagtgaaactttaggtgtacataatctctcttcaagatgcatttatttccatttataggaaaataatgaatgcattattttctgcattttatttttttggaaaaaagtatggaattaggccaatacacatgagaccatgtcttctttgggaattttgagattacagttagtgttgccagataaaatgcagagtttccagtgcaatttgaatttcagataaatgatgaatatttttgtgagtataaatatgttccaaatattgcgtgggatatatttatacaaaacaattgctcattgtttttcgcagattcaaatttagctgggattcctgtgttatttgctaaatatgccaattctagttttaatgcaattctaagtgacttgaatgatgagccatttatgtattggtttctgtgtgggacgagttgtgacaattcaaacttctcagagcctgcaagttttcactatttggtactctccttctgtcaaactgcatacttcacagggtgtatcccaggtagtgtggttctgaaaagtcaggccagcacctagcccttgttaggtaaccatgatttctcattaagacacatgggcatgtgcagtatcctgtacaacatggaagagtgggaatcttttgcactgggaagctccgagacttcctgatttgggttggagtaaaagagtattgtcaggaagtgctgaagaggttcctttccccttttgcctgagttgtttatcagtgtctggttggtaaatataaatatgtgaaagtagttgtgcaaatcttctggagttaaaagaaagtgaatggggaaaaatggacattttctgaattacacctttattcttctatgaaaagacactaaaagcagcaagaaataaagagcacttagtttcaggcactactgattatctccttgatttctttagaaagctgttactgatttatgtcaacaagggaagcaaacacttcattttatttaatcaaaggctttccttgcattcattctcctagtcacttaatattttacttggaacttataatatataaattctttaccttattacttttcccattataggtccaaccctgatgttaatttctaaaagaaaaaaattgtttaagttttattactcattctgactttgaacacttttccagaaatgcaattaaattggtgaatgtttgcaatgtttggttaaccaaaatgggagtctctaagatttttggatttgagttggttttaaaattgttttcacagaaatgattacttattaatttatccctctgtgtgcataagaatatcaatactgtccggccttttcattatattttcatatatatttttccttcataaaattatctggaacattctttaattccagttttgtggaagtatcagtctctatcagaatgtattaattaaattgctgtctatgaaagtaagcaaagatcattgtcatgataaacaaactatttttattttgaggctattcattgaaactagcccttctcactagatttgcttatttattgtattgttttaactctgtgcctcatattctgcattcttcactggctacaatttatctgtgtcattttctgtatccttattatcttttttaatctctttatatcggagtaccccagagcttagacccagatgtccttttcttttctttctctgctctcatgcgctacatgaaactttcaattccatggcatctaattgccgctaagttctgacaactctcgattttatctgtacccataaatgttctccagaaatctagacatatatccaaatggctattaacttctcaacatggatgtctagcagacatctcaaatttagtgcatcctaaactgaattatcaattcccacacactctacataccaaacttgttcccaccacaatgttcctgtatttcagtgaatagcaccactatctgcctgtgtactaaagtcaaaacccctgaaaaggattcttgaattgtctttctcttcatatccatatcctatatgacaagttttatgagctacatcttcaaaatatctcgtagaaccagtcacctctcaccatgctgaccactctcaccgtggctgcatggattactgtagtagctttccccttgtactactcttgcttccagttttgatgatccccagcaccatgtaatctactgtggcacagtgatagccagagaacctttaaatacaacaataagatcaaattatcatctgctctaaaccttcagatggttttcttttgcagttcgcccaaagtctctcctgtgtcatacactgtctggcctctgcctgtctctctctgattcatgttcaactcctgggcctttgcttcctgtgctttatgctaaaaatctcttacacaaaattctctgatccagccttatttataatttgctacacttgatagtacctaactttatatgttggttcattaaaaaaattttttattgtgttgtctttatctgttcttttattactcaatgatctagttctagcctatatttctaattaattacaacttctcatcacatgaacttctgccaaattaaaatattgcatgacagtagaacatcatgtatgcttttctagcttcatacattttctctttatgttcagtttaactttctttttgagtttttgtaatgtgctatcaccatttagttttatattaaaaagctaattatttgataaaggcctttcctaatacaatacccctcacatccatccagattcacttgtggaacttgctatattattattatttttttgaatgctgtcaacatgtattttttattcctgaagttgagaatccacactgttcatctttttatcttctgtaccaccatttcaagtataagagacagtcattacatgtttagtgaataaaattctgcactttcttgtcccatgaaagtggtctgcaaaagcattttttggctacaagtcctaataattttacttaatcattctagtttgcaaacttccactgctttttacatagttaagcatatgtttattctcaaataacaaatctcctaaaatagtgcatgtagaatattttgacttcaattgttatattgtaggatatcaagctactttgaagcaatctgacttatgagtagaattgaatttttgaataagaacaatttttaataacatttttcaagattttgctgatgatgtttttgagactttttcctccttttattcatttccttctaagatacttaaattatgttttggagacaatgaaatgtctaataacgatttatgagaaaattacttcttcttgcaagtcatattgctagaagtaatctttttctcccttccagcagaacattgggcaccagtgaggtttaacaagtacacctctagttttatggcacttacatgaaatatgaatttttggcttatgttatagtgtagtagtccaaattaaaaatattccaaagacattttatgcctgtaatgcaacaatatattaatctgttttggtactcttttaaaactactagctgtgaagttaactcagctgctgaaatttccccccaaggtgcttaattctttactcagagatcagttatttcagatgaattttgaaaaaagtgcttaatgtcctttttttttttctgagaaactgttaacctattttaaatcaaagaaacaaagcaagaaatagaattctgctcactgatataggatatctgtgacgtactgaagaatttggaggaactctcatccctacaatctttacatttccagatttgccctctaccgtccctcagcaggaaatctgtgaggctccatcccattgtgagccttgtcttatatgtagagttggaatgtcttatgtaaaactgaaaggagaagccaactctaaagtgccaagtgttgtctatcaagtctgccaagacctctcccaagaaccactgccacagcttattgagcagcttatcagccactaaccatgcacttctcactttaagatggatgtacttctatctttctgaactatgcccttcagaagtaaatttagcattcatctgttggtgagttcttccaatttttctttgtttgaaaatatttattttattattgttcttgaaagatactgtattagtccattttcatacttctataaagaaatacctgagactgggtaatttataaagagatttaaaagactcagagttccacatgtctggggagacctcacaatcatggcagaaggaggaggagcaaaggcatgtcttacatggtggcaggcaagagagtgtatgcaggggactgccctttataaaaccatagatctcatgaaacttattcactatcacaagaatagcatgggaaaatcccacccccatgattcaattaactccctccaggtccctcctatgacatgtggggattatgggagctacaattcaagatgagatttgggtggcgacacagtcaaaccatatcagttacttttacttgatgttgagttctaggttgtcaattatttattttcagtacaagctgaatatctcttatccaaaatacatgggaccagaagtgttctggatttcactttttttttcagattttagaatatatgcatattcataatgaggtaccttgggaatgagactcaagtctaacttctagttacttagttttgataaatttaggtatattttctagttccctttaggtaagtctaatcagtttgtcatctttgagttttttatttcaacaattatacatatatattttcaaaatttttatttctaaatgatcttattcgtttgttttgaaatctatcttgtaattttggattatcttttttatttttcatgtttcttgccaatgcatttcttgtttctttaaaaatttcatatatatatgattgtattgtttatctctttaacatttttatacatatacaattaatggcaattttttgggctggctgtttctcaaaaaatgattttctgataaatttgactatctttgataaaagctcatattggttgttcttaacatttgtaaaaactgaggcctaaattgaagattatttcatccagtaaaacttgcttttgcttctttgtgagacaggcagtatcatcaatctgagaccctaaatttaaatctaaagacatctcctttagattccttggctcaagctagcagactggtcactccctcctcttcccttaagcaatcttgatattagaattttacctacacttctactgtgcttcctactccaagctcagatttcaactatttttttgcctcttggaagttttctctacttccatctccccaactcagaagtacaacaaaatttattattttatccaagttctatccacttttccacattgataaaaccctaagaatgcatgccgtaatagtagtaaaaatcaattttctttatctgaaaaattattttgcctagcaatattttgtattgattagtattgtactttatgaaattctaacaaaaagtgaattaaatttaaaaaataaacagaaaaaagaactttttcaccacaaaacagtttccaaacctcttaaaacactcaggaatagtcaagaatagctcttaggaagggttgtaaaatcattctgactactgtttctgattttgtcctacaatttattgcctttctgaattgcgaattttttctgaaatgctgatctagtttctaatgctgccaaggagagtgtctcactcagccaatatttacaactacttcattttgttccacaaagggtaatttgtccttttgggttttctataaccctcctttatctacttaataatgtggaacaatttcccttggatgggtctgagcacttttgaatggtcactgggaaatttccttcaatcttagtatctgtacatgaagcacttgtcttttgacaacctcctaagaatataatgaaaggtcttaatgttaatatcctgatactcaagtctttttcactaataggaggattcttaaaaattgtcattcaagcaattatcctgccagtctgctttgatatcatggtctaatgaaaacttagtgatttctttatgatttgatggccctatgacggtaaagattgctgtgtgagagtaaactaaatctaatttaggaggtgaggaatggccaggaaaagcttctctggagaaataaaattaaaatgagggctgaggtcaaataagaataagccaacgtgggaaaagaaatattttaggcaaggaaaatgcacatgccttgaggagaaacaatgaagggcagttatagaaatagacagcacagaatgactaatttgtattcagtgatgggagtggttagaaatgaccttgaaagaagtgggaagaattttaacatcagaaacaacatgttcagaaagttagacttaaaatataggaacaatgtataacttttaaagtatttagttgtaacagtgaaaaaaatcatatttgaaattaaaaaaaaaattccagccataactggagaaaggggatttggttgggagtagagtctgtagtggatttgggatgacaaatttggaggtgtggcagtggtctaagtaagaaataatggtggattggacgatggtagttacaatggaaatggacagactcttagtgtcttgatactcaaatcttcttgattgagattaagacctttcattaaattaataggacattgtcaactgaggtactggaaactacaagtattggtgacaagaataaagaatcatggtctacaaaattaacaccagctttgaatcaaatgtgatctattcatccttaatagatgaaaaaaacactatagtgaaaactttcttttttcccatttttaacagagttccttttctatcctcagtctttccatcaaataacttatcacttctacctttccctgtcagagatgaatgagatattttactttttttctgcacagtgtgacatttggttcttttcagtatcctaatgcctacccctttgtttttatttacatgttgtttttcagaaaaccaaaaaagagattgcaatattaaaatatttcatatcttcactgcatgtagaagagggagattgaaatagctttttggtcccttctcaattcttttttcttgatatgatggacctagtttaacccaaacatacttggaataattattgtagagttacaaattcaatattaggaagttacatctaatttattaaaggtgtagttttgagttggcaggaaatctccttatgtactgacttatgaacccattcactgatgacatattctgattggctgagaaagacttcttgagatttaagctggttttagaatttatttaattagtgcttgtaaatcattaaataatgtaaacatgtataaaaatatcatatttaacccttaatgtataatatatacagttattatttttcaattaaaaataaattttaaaatgttttagaaagtggtaggtacttttatacagctaaggttcaaccttgcaatctttctaaagtatattcattaaaaaattgctactaatttagaaatttattaaaatttaaatcttacattggaatcatttgttatacaaaacagtatatcattaagcaaaatcaaaaccccttactgcattttattttgtcaaagattagtgtgcaccagataattaaggagagattttgtacagcctattgccatagggaaagcactgcagatctgaagattagtgtcctggcagggtgatttttgccttagacattcatagggaggagtagacaattttcaggtggtgtgatttagagttgtgactgctttacaatcaagggaagtctcagtcatttagctcaacaggaaatgtttatctgtgtgtctggctagtttcaaggggacaaatagttcaaatcttagctaatcactcttgagacacagaataagaatttagagggtctctctttggtcttttctaaccagatattaaaggaagtcatatgcaaatcttataggagtcagtaaaagagtgtactatgagtcttatttgaattttatggggaaatgtggttctttatggaaagatgtttcctgaatgcaaaagcctggatttgttgttgttgttgttgttgttgttttgttgtgttttttgttttttgtttttgttttttttttgagaccttgtctcaaaaacttcgcctaggctggggtgcagtggtgcaattatggctctctgcagcctccacctctccaggctcaagtgatcctcctggctcagcttcataagtgcctgggactatagacgtgaggcactgtgcccaccctggctggggaaattttagaagacaaaaatttaggggcagatttcctaattatcagtgtgtattgggaaaatagggattgagtaaagttaaatattgtcatattttacatgtgaattccacattcctgacataaatatatgtcatcacagtaatacattttcatcacttcttcccagatgctgcttgtttcacaaaactgagtcaaaatttaaattttggagatttggggctataaagaaatgttcgaaggggttaattttccagaaacatatctcgttttatctggtatttgcaggaatatcaagctgtttgctttatgtttatggtagaaagaaacattattttagtatagttagtattttattgtcttttatttgatttattttccatgataaactgtagagttttactaatcattattagagcacactcctaccgaatattattagttccctggttgaaacaaaatagtagcttgcttaggaaatgattttacagtgtttacttaaatttgaactgtttatatgttgttcattaaatatgaatcaaatgtttcagaatattattgttttactactttttgaaagcttgacaagaaatcttctataatagttcagtaaaattacatacagtcttatgttcgatcaagctgtgcatgctcccattctgtgttgatgaacatccttctattttaggggaaatttcaaataaaaactgaatttgagctttttttctgagtaacttcttgcccataaccctgggctggttgccaagtaataatgtgattgctttacagtcagtgagaagtaattcagtggcgttttcccatttgtaatgcctctcaatgaggaataaggttgttaggcaacagatgacatcaggtaggagcaggaaaaagacttctgagttaagaattcacaccaaaaatcactctattttctatattgagtcaatttttaaactgctgtctggaaacaattttagatttaaatattgtaagaacagtacagagagtttctgtgtacctttcactcaggttcccctaatgataacattttataaatgttatatagtgtaatttaaaaacagaaaattgaatattataaaccaaactatctgattttttttttcagatttcaccagtttttgtacttacttatttctttttcctttgggtttttcatggtggttgttacaaaatgctatgaaatattatcacatgtatagatttgtataacccccaccaaaatcaggatagaaaactgttctggtgctccagagaaactccctcatgctacctgtatgtagttactccctcttcctaatcctgatccctggaaaccactgattttttttctctatcacaaattttttttattttaataggctaaataaatgaaatcataaattatgcaaccattgagaatgactttttataaaaaaattgttttgaaaaatttaagactcataaaactttgcaaaataaatacagataatttgcattacacagtttcctcaatgatgacattttacataaccatcgtatattatcaaagtcaaaatattgacattggaccagtattatcaagtaaactacaaaacttaattggatttcatatttttacacatatttttaaaaagtttaattctatgaaatttcatcatagatatggattaatataattaccaccacaatcaaaatagaaaaatgtttcataatctcaaatcagccttttcacactctccccactaaacctaacccctggcaatcatgggtctgttttagacttttatcatttaaacttttctagaacttagcataaatgtaatcatatagtatgtactcatttttggttcagtttctttcacttaacatagggcccttgagattcattaaagtatttgcttatatcaatagtttattccttcttattcctgagtaggattactttgcacagatgtaccacctcttttatacctcacttacttggtaaaggacatttaaattgcttctagtttttcactattaaaaacaaagctgctatggaaattcatggatgggtttttaatatgaccgtgagtttttatttctctattataaatacccaggattatatgatatgtgtatatttaaacttatgagaaactttcagactgttttccagagaggtcacaccattcttattcccattaggagtatgtgaaagatccagttggtctgtatcctaacaccaggatttggtagtgtcagaatttattaatttagccattctaatacatttatggtgttatttcatcatagctttaatctgcatttccttaatggctagtatttttcttttcatgcgattttttttgccttttatgtatcttctatgattaaatgtctgtttaagacttctgcccattttctgattgaatatgagttccttacatattccttacatattccagaaacaagccctttgtaacataagcaatttgcaatatattttctgccagtctgtggctagtcttttcaacctattaacaggatattttacagaacaaagtgtttcaattttagtgaagtttaattaataaatattttcttttgtaaattgtacatttggcatcatgtctaagaatgtgtcacctagcccaaagtaacaaagattttctcctgtgtttttgtctaaaaattttagtgttaggttatttatatctctaatttattttgagttaatattttatacaatttgtaagtttagactgaggcttattttctgcctagggatgtccaattatttcatttgttagaaaactatcctttttacattgaattgcttttgaatcattgtcaaaaatcagttgtgagtactttggtttgcctattactgaacttcctattttgctccactggtatttgtgtcagtccccctactcatgcttcttttacacttactgtaaagtatgtagaaagtcttaaaatccagtaatgtgatttctcaaaccttattattcattttcaaattgttttaactcttctatagttcctttgctttttatataaatttcagaattactttgtatatatctacaaaaatatcctaagtttttgatacaaattgatagaatactataggttagttttgagagaattgtattattgatcatgttgcatcttccaatcaatgatcatggtgtatccctacatcaatttaggtcattgttgaattatttcatcagtgctttatagtttaaggtatacatgtactgtacaagttttgttagacttatactgaagttttccattttggagagttatttagtaactttaaaatgttaataacaatagctcattactactctatagaaatatacttaatttttatgtcatggtcttatattctgtgaccttgctaagttcacttactagttctaggatatttttttttcaatagattctttgggactttccatatagacaaatcatgccatctgttaaaataggaacagttaacatttctttcttttccaataaatttctcaatctgtatgcctttaatttctttttcttgccttattgcagtagctagaacttctaatactacttaaataggaatgatgatagtcaacatctttgcttttctcccaatttagggtggaaagtacttagtctttcatctgtaagtttgatggtaactgtgtattcttgatagatactctttatcagattgaagaagttccattctgttctcagtttgctgagaattttatatcagtgagtattgcattttggcaaatgttttttctgcatcaactgatataactttttgtctttttttctttatactcttaatgtggtaagttttcaaatactaaaccagctttgtattcctgaaataaactgcctttatcattgtatgtaattaatttatctataatctggattctatttgctagtattttgttgaggatttttatatgtatgttcacagggattattggtttgtaattttgtttttttgtattgatgttatctagctatggtattaaggcaatgctgggctcactaaaagaattgacaagtgttatctatttactggataaaattgtgtcaaattgaggtcatttcttaattatgtgtttgatagaatttactattgaatctatttaggctgagtgtttttttaaaagctttttaactagatactcaattttgttaataaagattattcatgttatctatttttatctttgatatattttgattgttcatattttttgaggaatggtgcatttttttttattccaattggataatttctattgatttgtcttccaactggctaattctttcctctgtcatgttcattttgctattgaaccaatcttgtgagttttcaatttttcttactgtatttttcagttctaaattttcaccttcgtttttctttatatctgatatttctttgtcaagattttctatattttcatttgattcaaataatttctaattttttatcagagtatttttatgatacagattttaaaatcatcatcagataattgcaacatcatgttgtaattagatacatcttgctttggtgtctgttgattttcttgctcaaattgatattttcatggtcgacatggtaaatgatgtttaatatattctggaaattttaagttgtatatgataatatttcctatttatatctgctaaagcaggtgatatgcctgttaaagttcagagtgcatgtcctggccaacttttgtgggccgtagtttaaatgttaattgagatttcaaaacatttacagtgctcttctggtctcttctgtttatgtgcttttcattaatgaccaacttgaaatcttggcaatattctgcaccatcgttcagttctcatacattttgccctgtgattctggttggtttcatgcatggccgctctggagtttgcccagaacttcatatacaggatctctttctgaagctccctcttcttcctatacatagcctctattttctaattaggtgggagttggttgcttcatctttgctgtcactcagctagtgcaagattaggatagtagcagcgctctacttcatgagctccacagcacatgacaggaaggaaaaagagtgctgcttcttttctgatgcttagttcagcgttggaatgatcacatcgcttttttactccacagtcttcctagtcacaatgctcactgtggatgggagggaaagcacatctgctcatgctattgcaatgtggagatgattggtaggactctaacacacagttggcagagtgcacagtggggagagatagggatactgcctcctttgtgcaaaatagggatgaaagacaagctattgttcaaagtctggggctggaggatgcagtagggaaacagagaggtgcagcgttttcttggagggagtacatagtcaagagggttatgtctcattagccatccttttctgtgtgtatatatatgataatgggagcagataaaacaacaacaacaaaacccccacaaggatggtatatatacccccacaaggatggtgtatatatatatgcatacatatatatgcgcatacatatatatgtaccatccttgtggcggttttgttgttgttgttttatctgctcccattatcatttatgttttgtgggtttctccagtacccaggcagagatacataggaggaaaaaacaaacaaaacacagacaattcacttcccccttattcctcaagtcataaaatctctagctagtttgctttcttttctggacttttaaggtactctgatatttacttattttttctgagattttttgttgtaattcatagaaggaataagggactaacttttttgggggaggaaaacatcctatgttcagtcaatttttaaggccagacttttagttctagtctcattttctgtttttcagcattagctaaatatgttctgagtactctattagctcttgcgggcagttagaaaggagaagtagacttagttctagcccctccgtctattatgatcgagttcggataaaatatatctactgaaaaccttatgtgtaccagacactgttctaaactgggggtgaattatcgtggtctaattggggaacagaaattcaaacacacaaactcattatgaaaaattttttttaaaaattattgaaacaatgagaatttatctttttatatatgtacaattaagagaaggcataacaaccctgtgaaaactgagtagtttcacagttaggtagaaatttgattgactaattgggaagtgggacaaagtggaaaaatacaaattttcacacaataaatctacaaattcacataaccagtaaagcccatatagaaatatacttgttaactaagcaattaaattgatataaagaagaagaaaataagaaataagaaaaatgagggaaaacatgttgtgatttggttttattgagcagtatttcaggtgataagatcagtcatagagaaaggtgaactatatgaattcagggcattacacacatgtggagaaatgtcatatgattttcttactatggagatggtcaagtaccttattttaaaaatggatgagaatcccattaaaacaattttcagtttacatgagagggaaatatggagatagtaaaattaaatatcagtgtaatatctatataataccatgctcactagtgaatatgacagattgaaaagaaaagagaaacaaaagttaaagaaagacaaggtagtaactcaaagataacatcagagtcactctgacaaaatgactctgaggtgacatggctatttctttttataagatctgatagaggaaaaatgattacaaatattctttaaggaatatagtttttaaaaattaaaaacaaatgaaaacaataattaactcttaagggacttagaaactatttcttataaagaaagtataatttatttctaaaaaagtaatgttatttggaccctatccatattggaaattagttcaattataatgaacgaaggccaaaatcaacttttaagaattattttcagtttgtttaaaacatatattgattccttaatatttgagtacctgatgacatgaacattcacaattttagaaaggccaaatttgccactctaaacaagagaaaacttgtcacagccagacgcaacattcttaactctacctggcacctaaaaatgttaggagaaagacaatgattcctggaagggacatagcttttcttggcattttgtgggaacatctgctaatgctgaagatggctatcgatgaaacgagagggacctacaatgctttgaacgtgtgtctgctctaaaattcatgttgaaactccaccatgcttagcatgttactgccatcttcatagtccaaaaatggttgtcatgaattttatcattgtttcctttgtccaggcagaaaatgggagaaggatgaatggaagaagtgcaagcaactaaagggacataacgctaaggctattcatcttaaaaagctttcccagaatctccccagggatgtccacttagatcttcctggccataagtgggacatgtggtaatgaagtcaaggattgttagagtgctagcactcccaccactgtggaagataaaagtaagggagaagaaactattcattgctttcttttgaatagaacaaagcacagaatatgccccaggagatggggatttgatatcgtcaagtggttgatatagagtgaattcatcctaagaacagtatagttgacctcagtgcccttgaatattcaatgtggtttgcataacaagaatacacaaaatctccatacctcttctggaatatactttatttttctgagcctatcttctggtccaaaaacttaatctaatctcttcaccctgagcctcctatttttgcttatttattcttcagatttatcctcaattcttgtttttagagtctgattttggctttttctgaaatttactttctgtctgtctaggagaatttgatctctagtatcttacctcatcacttcccagcttttgtagtattttgttctgtttttctctatgtggttgttgcttttaatctctctgtgtggctttctcgattaagctgcaattatggccactagtggctcccaggctcacatcttttctgtgcatcactacaaaggaagtactctatttttaaacaattcttgtttgaaatatcatagagaaagacacttttaacattgtctgggtcacatgcccatgtcagaaaacatgagttgtatggttaattctaccgtgaaatgagtatgaatgctgccacaataatttccctaaaaaaaaaaaaaaatcctggggtatttctcagcagaatcagagaaaaacattaacaggatttgaaaaatgatgcacattattctaccatatgaggttcaatttattttctttgtctgtatttataaaaatgatacacaatttttgtggttggtaaaatggcttgaaactatttctaaaattttggtttagctctcaattaacaataagtcaattaagtatttcataaattgtttcaaatttcacagggcagtctcctctatcaaatcagattctatgttttttaactatagagagtaggactgtgtttaaagatgacaaggaaaaaaagatgatggaaatacatcttacgtcagatgaatagaaacatcaagcaatatgggtctgcaacctcttaggtcctgttctgtagtggagataatagccatgggtccagaccctgattgctctaaaaagaagagagaaacgataaaacatattttacacttactaaaattgtgaggtacaatatggccttttatctgataatattgggtttgaatgggcctgttagaattttctgcattttccagcacactctacccagagttatagttccattttgaccttcatttttaggctgtgactatgatttagcaaaatgtattttcatttagttccagttcaatctcattatctctgagaatgagtgttactgcagtttgattgaacaagtagtatttgatgattttcattccaggtggacagtaaataataaatacagtgtattactgttgaaagtgcaaatgaaagatgttaccagatgcagaggaatagtaacacgttttatctgaaagcaatagcaccttaacatttgtgtaaaacaattgttaacaaaccaattccacctatatcatttaattcttagagtgtgttaatggggtatgaaatatttccttcattttaaagaaaagaaaatcattaccagagatatttacatgacttgcttaatatccttagccattaattgtagccaagaaactcaaatccaagacttctgattctagttcagccttttcttaataccacaattgcttatttgaacatagaagaaatattctctgcctgctccatgacaatgataagatgataggacttggagtaaaggtgcaatgtgattatctttatgataggatcagaaggtaatatattcattcatttcaataatatctgtcatgaatctactacaagctttatctctagtacctagcagaatgtctgatacgtattataggtaatataagcagatatgtaagattaataaatgagcaaatgagtcctacatcaagcaagcatcatactacactgatgatacagtggtaagataaagaccctgctttcgagaaacttgcttgttagcaggagatacgtgaatatcaataagaaaatgtcatatagagtgaaaagtactgaagtgaaaaataaacaagatgttctgaggcatataaatggtggataagttgaacaaatcttcagtgaacaggtgatacttgaggttgaccatgaaggactaatcagatcttccgtcatagagagaggaagcctcacactcagaagtgatgtgtgagagaatataggaagttccatgtgaagtggtgcttcaagcagcctaggttggggagcttaggatgaaacacaggactatggaatatgattggcacctagagaaaaacattgttttgtgtcccctgatgacaactgaatttgttttttagaacattgactctcgtggcagcagggggaattgattggagtaagaagagctgtgagccagagaatgaattcctgaaccagcccaagaaggtgaaagtgaggaacagattctagagatgactagggaatagcaggagctaatccacttctgtgagactctctctaagaaaaagtgctcaaaattacaaatacaaaattaagtatgaaagcaagtatttgtttataatgaggaagtaaataataaaacattaccaactttagaaggctaacagggccaggtgcggtggctcatgcctgtaatcccaacactttgtgaggctgagacaggcagatcatgaggtcaggagttcgagactagcctggccaacatggtgaaacccccatctctactaaaaatacaaaaattagtggggtgtggtggtgggtgcctgtaatcccagctactcgggaggctgagacaggaaaattgcttgaacccaggaggcagagattacagtgagccgatatcgcaccagtgcactccagcctgggcaacaagagcaaaactccgtctcaaaaaaaaaaaaaaaaaaaagggggggggctaaaaaatactacaaacttcagataatccagaaaaataacagaatagctatagattaataactataataatacaataatagttaataggtaattgaattaccttcttgacaaatctccatatattatccatataaaaatgttttggacatatactttttaatatcttcatatgaaaatgattttataatactattttccatagagaggtcagaaagaaatcaagactttttctgctacgattggttaaaaaatttactgatagtttggatgcaaaaaatatggttttacaccaagttgtatctgttacttatagtactgctactggttgctccctgccaacacagaatttctgataaatttaactttaagcacttttcatcaaaagaaggaagaaaaagagcatggcaggtttataattatgcatcctgcattataaatcatatttctaaccagaaatactttcattttgattaggcacttatgaaaaccaaatattctttttataatgtgtatatatatatttaatgattggaagatttttccacatattagctactggttctgcacattttaaacaatatttctcctttattctcatagttccagtgacagatgggagaggacaccttcatacagcagtaaatttttggccattctccttcctcctgtgttgctgggtgggtcagcacaatgagtggtaggagtacttctggaagccattcctacagcagggatgctagcaattatgaaaccattcctagaagtgtctgaaaaccacaacatattccaataaaccaaaaatgaagtatttccaactcagttgccccttagttggattccaaacatgctttgtggtcacccttacattacccaacacgaagggaagtgtgatggagcagcaatcactgtggagacagtcatcttaactgatggtgattctaacttttgaaagttttagaaaaacatatatacatgtgaacacattggcagggactctctcagagcttgggaaggagatccatgcacagaaggggcttccggtttatactatgttagcttatggtgaacatgtctctaggaaatagagcccacttctggggactggttggatatgaatgaaggatgagagaaacaggaatctaggaagtctggcagatttttctagcttgtattccatgttgaatgataatatggtaaacaacaacaacaaaaaatagaatgaccacttttcaggcttgattgtcctatttttagtattaaaaatctcacattctggggaaacacctcttcaggaagcaaaaatctcagtttttaggtaaggaaggttgcagggaagtgccatactgaaaaggcagccccaaaaatagtaactgaaagaaagccgtttttagtgtcaaatgaataccagtatagattatctgtctttcatagttgttgccgtttttacctctgatcactaatgtttgcagctatgattggcagttctccaaaatggttcatgcttggttggatcactccaagtgacacaatttgtgtgaaaccttagtgcactgtaatcacgaacattaacaatctgtctttggctttgcccgtggattaacttttgtgctttgtattgagatactgcttgtgaaaaaaaacaaagacaatccaaataagaacaaacagaggccatttaatcagagcttgataaagcaagggagtcagccaccatcacttgcatttggtagactcaaaggcagacaagggagctttgtagtggataaaaggggagacttcagttataccttgataagaggttattggcacaaagaagctggaagtaaattaactagcagttgggcatagtatataattggtttgggaagtatatttggctctctctgattggtgctgaggtggaagtcagggcaaaaattaggaaagttggcagtgaatgactaagtcttgacaattctgggctgattcctgcggagcttttggattaaaattctattgtcttatatggtctgacccttttctatttgtacattgtccctcaagacagtttaattttaacattgtaaattttatgaccatattttccaagaacctagataatgaaaataaaagcaattacaataccaacaccagtattacccatatatccccctaaaagaaggcttaataactttgttacattaatggcaaatggaaaaacacatacagctgcattaaggaaataaataaccaaaacaaattattttgcagattatgcaaaaaataatttgggattgggaatggtggagtaggggatggggaaacataaggttagcataagacaggtaagtactgctaaatcattcaaaagtttttatttttatttcccccaaaataccaatggtcagttgaaaacagtggccactgaattaccttaggcatatcccagtaatgaacatgcattatcatattattcccttgatggttgtatgaaactgtgttaattacttggcctgattcagaagttgcatctaaaatgtcctgttggggaaaaaataggggattttgataacagatgcattggcctcttatggggtagatctgattctgtcagatcttagcaaagattatgttttctacagtgggtcaagggaggtgcatggaatcacagtagtaacaaaatgtttcttttagtacatagacactttaatttgaaaaattaagtttcaaatagtgttcttaatttgtatgaatattttaatgaaactttggaaaagacttgctcctatatccacatattcagtagacgatgaaaataaaaatgttggcaaattccattcagtcagtaaactccttatcaaagaaagtaaaaagatcttgccagctaaatgtcctcgttaccttctacaacatgtagattaaaaggtgtgtgatctgcttgcgtgccatattagggctttcataatgaaagtttttggtcatttttagtgtcctcaaatatgaagaagcacataattatatttttgattgtataggtatagaaggaaatagcttcattaggcatgtgcctaaaagatggctatcattgttgcttgacatggaaaagatattaaaatggtggccttccataaaattataatttccaactgtggaacaagaaaaaaatccttctctaatttggagacatatgagagtaaaaatagataaaaggattacagtaaagcagaaatgtatatgctgtttcctaaaaatatttgataatctttgacaagaccataaggcaactagaaaaagatgaactgactacacctgagttttgtaaggttacatgtaggttgcaacaaaaactcatatagagaatatgactcatttttagaaataagactccttcagaatgcaaaaagatgttaccagaaaaaggcaatgagttaaacatagcttttcaaatttcattactaaaactgcaacttatttagaacccaattttgatttaacaaattcaaattacctctgtgccttaaaatgattccctgagaaacaggttaccttatgaaaacattcaatgtgctttgaaatgtttaaattatcgacatttgaaacaggagactatatgacaaataaatacatgcaaaggacctgattgattcatagctggattacatgaacaagcctgtaggtataaaggaggaggacattttaggacagctggaaacaaatccctatgcatgtgaattctgcttttgctattaagtaaaatcttaaataatccatgttcaaacacttttcttgcgaggttactttgttgatgtcatcacatttgtctgacacaaggagtcagtgtaattgagcttgataagaacatagtgctagtcaaagagaactttctgtttggttgtattcagttttactactacatgaaagaacagagctagtcatctatgctgcaggcagctgagataaatggcactggaaaaggaacacaaaaatattctactggctcacaggacagaaaaaaacatgtcaatgttatttttattaaaaataggtaatgtctgtttatttaatctgcattttcttcttttaaaatgtcctaattaaaggctcttaagagtacataatcagtcagagctaagatggctgagtagacacagccataaagagcttttcccattgagagagaccagatcatcaagtagaggaggatactccaaatatatcttcagtaaaaagacattgagagtggacagagggtggatacagactcaaggctgaaagagaagagagctgggaaccctacaagaggttgccaagcatcaggacttgttcctggcccccagctgctcctagggaagggctgagtgaaataggcctggagtggtccactctcaccattgatctctgggattctagctgaaggagaccccaggacccccaaggacatctgagctggcagagaaaactgcctggagagttggtagagacaaaactcctgcattaatcaagcccagaatatttgacacaggaacagctgcagtggagcatggccatgggtgcccatcccacaaagttctccatactccattaggcagctttagactttattagctgctggcattggacagagcaaggctatgcttcctgtgggatggggtctgatattacttggctgtgttgccacccaaatcttgtcttgaattatagttcccataatccccacatgttctaaaagggatccagtggaacacaattgaattatgtagatgggtctttcccatgctgttcttgtgatagtgaataagtgtcatgaaatctgatggttttataaagcagagttcctctgcacatgctctcttgcctgccaccacgtaaaatgtgcctttgctcctccttcaccttctgccatgattgtgagtcctccctagccatgcagatctctgagtccattaaactttccttttataaattactcagtcttggatatgtctttattagcagcataagaacagactaatatagggccagtctgatctgagcaaccctctgtctgctggtctctcccagtgtccctgcctggcctcatccacttacagcactaccccagcatcccagccaaagtgctttccagtggccaccactatagcttctttgccaggagaacctacctaccgattcgagcacttttgcacatatttttggagaccccaaccagtatgcacccacttacagcctttccccactggtacacactcatccacagcctcatcctgccaccttattagcatgcatatgtgcatagaccccttgctgccctgctggcacacacatgcatacatgaatggagagtcgcactgctcctccagcacacatgtacatggggactcattgttgacatgcatgtgtgtgaggaccactaccaccttgctggtgcacacatgagtagggaaatggcgactcaccactgccctgctgaggagctttcgtcagtagcccctgttggagtgttgctaggttaactttgacaagccagagatcaaagccatggacctggttccagcccccagggttagagcatatagcctaggagtgctaagctgagattctggtcccctgaatgtatccagaaacaaaaccaatggaccaaacccagcttatactacagtcaaaccctcaaaggcattaaagaatatacaagaaaaaaaaaaggccacatccgaaagacaacaacttcaaagattaaagtaacatcagcctacacagatgagaaagaaccagtgtaagagccctggcaactctaaaagtcagagtgtcttcttgcatccaggtgactgtactggctcccagcaatgtttcttaactggaccaaagtctggttatctggaagataaggaagctcatcaagatacagaagaaggttggaactcaatcaaaggaaaacaataaaaccatccaactgttgaaagacaacatagacatttcaagaaagaaagaaccaaatttaacttctgaaaataaaaatttcactacaggaatttcagaatacaactggaagcattaataacaatacagcaagctgaggaaagtatctcagagctcaaagactgttcattttaattgacacagtcagacaaaaattaagacaaataaattttaaaagatgaataaaacttctgagaaatatgggattatgtaaatgcacaaaacctacaactcactggcattcctgaaagagattgagagagagagcaagcaacctggaaaacatatttgaggttattgtccatgaaaatttccccaaccttgctagagagtttgtcatgcaaattcaggaaattcagagaatccctgcaagatctatacaagatcatcatcttggggatcatcatccccaagacacatagtcatcagattctacagtcaatgagaaggaaaaaacttaaagccagctagagataaggggcaagtcgtgtacaaaggctatcccaccaggctaatagtggccttttagcagaaactttgcaagccagaagagactgggcctatattcagtatccttaaaaaatagaaatagcaactgataatttcatatttagccaaactaaatattaaattttcataattgagagagaaataaagtccttttcaggaaagcaaatgctaagggaatttgttaccactggacctgccttacaagaggtccttaaaggagtgctaaacatagaaatgaaactatgcctgccaccactcttaagtatattaaatataagcgaacatagaagaaatgggtaaattcctggaaacgtgcaacctcccaagattgaaccaggaagaaactgaaatcctgaacagaacaataacaagttccaaaattgaatcagtaataaaaactctaccaactggaaaaagccctggaccacagagattcacagccacattctaccagacatataaagaagagctggtaccaattctacttaaacttctccaaaaatcaaggaggagggattcctaactatgaggccagcatcattctgataccaaaatctgacagacaaaatgaaaaaagaaaatttcaggccaatatccccaatgaatatagatgcaaaattcctcaacaaaataccagcaaatcaaatccagcagcacatcaaaaagctaatccaccatgatgaagtaggctttatccctgggaagcaaggttgataccacatacacaaatcaataaatgtgatacatcacacaaatagaagtaaaaacataaaccacatgatcatcttgaaataggagagttccctgacccccttcgcaggatgtgtgacaggggtgtggctcacctgttcagcaactgcatgcgtgctcaaacaccttacaggagcggggagcatgcagtcaggtgcagtagctgggtcaagcatttttgggctctggccccaatggtggtatctacggggtgggttcctgtgactcctgaagccatagggtgtgttacagtgctcctttaggtttgctgtccacaacggcttaagtgttaaccagctcagtgccctcttggtatgcgggtccttttccagcatccaggaagaagcaggtcacacacggacttgaaggatggtgaatgaagaggttttattgagtggtgaaggtggctctcagtgggatggatggggagccagaaagaggttggagtgggaagatggtattcccctggagtttggccatcctgcaacggatctcctctcagaccgtctccagctgaactcctctcaacgttcaaatgctccttcttttctctcctctgcagcactgctcttctgctcctctgctcttctgttcatccactcatttgctcgtctgctcgtaaagcttggggtttggggtttatatgggtacaggatagggaaacgtggtgggccaaaaggcaacatttgagcacgaaagcaagaatgcctgttcccatttagggccatgggcttccagtcttgagggtggggtctttgccggggaactgccctcttctacccggtatttccctgtctcctgtccatatcaatctcaatagatgcagaaaaggctttcaatgaaattgaacatcgcttcatgttcaaaaaagccctcaacaaactaagtattgaaggaacatacctcaaaataataaaagccatctgtgataaatgcacagtcaacatcatactaaacaggcaaaaccaggaggcatgagaactggaactgagaactggaacaagacaaggatgcccactctacgactgctatttaacacagtaccggaagtcctagccagagcaaccagggaagagaaagaaataaaaggcatccaaatgggaagagagaagatgaaattatctctctttacagatgatgtaattctgtatctagaaaaccccatagtctctgtcctaaggttattagagttgataaacaactttagtaaaatgtaagggtacaaaatcaatgtacaaaagttagtagcatttctatacaccaacaagtaccaagctgagagccaaaccaataataccaccccattcacaatagccacacaaataataagataactaggaatagagctaacgaggtaggtgaaaaatctctaaaatgagagttacaagacactgttgagagaaatcagaggcaacacaaacaaatggaaaacgatttcatgctcactgaaagtgtgaaaggaaaatgaatctcaggatccaaaatcactaagcctgcctctcgttctattcctgaacaagatagttgctaacataaaaaagttacatacctccctcacaatttatccacaaggaaattccttgcagacaaagcacaggcagagctcaaagttattcctcttttcactgagataaatgcatatctgattgcttcctttggaaaggctagggagaaagttaagcaatataactgtaggtgtttatctacaaatgacctggaagtcccctccccactttgagttgtcctgcttttctggagcgaaccaatgtacatcttacatctattgattgatgtctcatgtctccctaaaatgcatgaaaccaagctctgccctgaccaccttgcacacatgtcaggacctcctgaggctgtgtcatgggtgtgcatccttaacctcggcaaaaataaactttctaaattgactgagacctttctcagtaatttggggttcacaataggaagaatcaatattgttaaaatggccagactgtttaaaacaatttatagattcattgctagccctatcaaattaccaacattatttttcacagaactagagaaaactattctaaaattcacatagaacaaaagatctgaatagccaaagcaatcctaagaaaaaaaaggctggaagcatcacactatccaacttgaaactatattacaagtaatcaaaatagcatggtactggtaaaaaaaaaaaatagacacatagacaaatggaataggttagagaacccagaaataaagctgcacatctacaaccatctgatcttcaataaagtcaacaaaaacaagcaatgggaaaaggactccctattcaataaatggtgctaggataactagttagccatatgcagattgaaactgaatcccttccttatattatatacagtgatcaactcaagatagaataaagatttgaatgtaaaacgtaaaactataaaaactgtagaggaaaaccttggacacattctggatataggccttggcaaagagtgccggacagattctcctaaagcaattgaaactaaaacaaaaatgctggatctaattaaactaaagagcttctgcacagcaaaagaaactatcaacagaataaacaaataacctagtgaatgggaggaactacttgcaaactgtgcatctgacaaaggtctaatattcaggatctgtaagaaacttaaacaaatttatgagcaaaaatcaaaccattaaaaaatgggcaaaggacatgaacaggtatttctcaaaataaaacatacatgtggtgaacaagcatatgaaaaaaatacttcacatcactaatcaagagagatgtgtaaatgaaaaccacaatgagataccattttacgccaatcagactgactatcattaaaatgtcaaaaaataacaaattctcataaggttgcagagaaaagggatgcctatacactgctggtggggatataaattagtcttagtcactgtggaaagcagtttgatttctcatagaacttaaaacaaaactaccatttgattcagcaatcccactatgaatatacatccaaaggaatttagcatatttctactgaaagacatatgcactcataaattcattacagcactatgcacaatagcaaagacatgaaatcaaccttaacactcaacagtggtggactgaataaagaaaatatggtatgtatgcaccatagaatactatgcagccataaaaattaaatgagaccatgttctttgcagcaaattgaataagctggaggccattatcctaagtgaattaacatgagaacagaaatccaaataccacatgttttcgcttataagtgggagctaaacactgagtacgtgtggacacaaagaggggaactatagacactggggcctatttgaaggtggagggtaggtggagcataaaggtcacaaaactacctatcaggtactgtgctcactacctggatgatgaaatcatttgtataacaaaccccagtgacacgcaatttacccacgtaacaaacttgcacatgtaccccttgaacctaaaatagagtttgaaaaagagaattaattagttaaggaaaacaaaatttgtccaaggtgatatacattttggcaattgtatataattttaatgtagaaatttgtctaataagagtgcaatgaagattactaaaaacaagtagaaccatcacaaaacatatttgtttctaaaaattaaaaagaatgtgtaaaaatgtaactatacaatttatatatccaatgcaagttttaaaagagttaaaatgaatcgctaaataagaagacagaaagaaaattgtaaattgtaaacatattgttatagtttttcacatatatgttcttacttgtctaagtagacttgattgcctaattaatttctttaattctaattgccactattaactagctctattgccattttactgaaattatggcatttatgtagcagaaaggtaagtaataagtaaaacatactggtatgttttgattcataaataaataattcttctgtaactgaaaatttgtggaaatctatgtgaaaattcttgacaatataacttgaaaactgagctgactgtatttaaagatactcaaatttctgtttttgaatacatggttttgataaatctatttataaatacaaagatcagagtaaatatagcctcactaaaataatataaacttctatactgtatgcatatatatatttgtttttccttagaacaaattttaaacattattttgcctttccattatggtttaacattgaactttctggtttttctttttactttcatacaatatcctttcatacaaaagatgttgactatttcttttacttcagagagcatcttatttcaacgttttgtcttaagatcctaaatatttttctttgttgttgatatagtttggctgtgtgtccccatccaaatgtcatatcaaattgtaatccccacttcttgaggggttacctggtaggagtgattggatcatgaagatggttttccccatgctgttctcatgatagtgagggagttttcaccagatccgatggtttaaaatcagcagtttaccctgtgatctttctcgcctgccaccttgtgaagaaggtgctgcttcccctttgccttttgccatgaatgtgtttcctgaggtctcctcagccatgtggaaacatgagtcaactaaacctcttttgtttataaattactcagtctcgggtagcatctttatagcagtgtgaaaacagactaatacggcagtcaatgttttaaggctaacatttagcaatccctgtgtgattctgaattaaattatttaaatattctattttatgaatgggtatccctgatatatttacatctaggcccatttctaagtgccgaagaaaacagctatgaaagagcaatgctgaatgccccctcatatttttcttgtcctcagtacaaaatgatatttttgatattgtgagtatgtaataagttttcagagatcctccaaattaacaaattataaataagttttatttcaatgttatacagtttattgtttctgtcttaagcgtatattgagtgtctttgggaactgtattcataacaactgaaaagaaattataaattcaaatctttatcaaatgttgacacctttgtcatgtgacaattgaatgttgttttaataagaaactaacaccaaattaattctagaatatacagaaaccaaataattccaagaagagttcagatgaaatttttaattgtgattttgctctcagctaaatcaacatacaggtgaaataattctttgtcatttttttatcagctgtctcagagctctcatgtacccctaggacacatatgactttaagtagatcacaataaaagaacagaggcagaaacgaatgaagaaaacagaatgacacttgcaatcagagaacctggctttcagacacaaacctgtgcctttctgattagatgattttagtgactcattctttgagcttgagtgatcttatttacagaatggagataataattcttaatccataccctttgtgaaaggagtaattaagattatacttgcgaaaatgcctagtatgaattccggcaactggatgacatttagaggatcctcatttttaattttctcatttattcatcaagatttgtgatatacttctgttttttcagtccctagaactgattctcagtcccaggtttgcactttattcattccttctttcctccagcatgacttaaatattcgatttgcatgtttgttttgttcctgttggctgttccacagaaaggtgcacattttataaaatatcttatttttttcttcctctgaaatacatgtaaaatattattagacattagaaaataattctaacaattgctgtttgtggacttctccacactatagtgaattagccaatgttttttctacactcttcatgtatggtttttgaaatgttctaattctttttgtgttgtcagtcagttcagcccaatgtgatgttcataatcagtttcactggtgagtatgatttatcattcttcagtccaaaacaggttctttatgaaagtaatgccaagacttacagatacttagtatccagaatgtgcgtctaagacatctatcaagatattattcctaatacagtgtcctccaattccatccatgttgtcacaaatggcagaatttccttcttttgtaagggtacatagtattccattgtgtatatttaccacattttctttaactattcattcactgatgcacgattataacttgtcaattaaaactaaataaatacatatgtacatatataaacattccatttttctttcccaacctttaataccctgaccctttttaccacctcattcattcttttggccttgatctgaatgaattactgccttatagataggtcaaaaatacttggatcctgcctttgcctcaataaagaatgaagactctgtcatagttcttcaaatgtcccctgaactattttgcccttccttaaagctttcatggctctatttcctggaaactactgtcttttctgatctatttttatttctgtgcagttttccaggattctaatcagtattttttttttttttttttttttttgaaacggagtctcgctctagcgcccaggctggagtgcagtggcgcaatctcagctcacagcgagctcgcctcccgggttcacgccattctcctgtctcagcctcccgagtagctgggactacaaggcgcccgctgccacgcctggctaattttttggatttttagtggagacgggttttcaccgtgttagctaggatggtctagatctcctgacctcgagatccgcccgcctcggcctcccaaagtgctgggattacaggcgtaaaccacagcgcccggcctctaatcagtgttaaagtccgagttatggctgtactgttcatgaagctgtatgcctttgtataaatactggtataaattattcttattagttgtcagcagtctctgataacagacataattgtgttctctatttttctcctgaagtaacaaatctccatatcttcttgttttaaagctcatgcccttccaaggtatttattatttcttttattatttcttcaataaatatttttgggtccctcctttattcagatctcagactaggtgaccaggacttaagatcaaaacagaacaatacaaaatatagtttggtagtttatatcttccaagggttttggtccctttcatctaagttatcaaatttgtggttatagtcatttgtaatatttctttattattattattatttttgagacggagtctcgctctgcaccaggcttgagtgcaatggcacgacctctgctggctgcaacttccacctcccatgctcaagtgattctcctgcctcatcctcccgagtaagtggaaatacaggcatgtgccaccacacctggctaatttttctatttttagtagagacagggtttcaccatgttggccaggatggtctctatctcttagcttcgtgatccacccaccttggcctcccaaagtgctgggattacagtcgtaagccaccacgcccagactttttattgtatttttaatgtccatgaatttggtagtcataacctctctttcatttctgatattgttgtttttttctttttttttttttttttgaggcagggtttcactctgtcacccaggctggagtgcagaggtgtgatttcgactcactgcaacctccacctcctaggttaaaacaactctcttgcctcggcctcccgagtagctgggattacaggcgcctgtcaccacaccagctgatttttgtatttttactagaaacaaggtttcgccatgttggccagtctggtcttgaactccttacctcaagtgatccacttgcctcagcctcccagtgtactgatattgataatttttgtcttctctctcatttttccttcattagcctggctagaagtttatcagttttgttaatcttttcaaataaatgtttagattcattgatttttctctattgtgttcctgttaatatagtggtatatggtggttcttcaactctaaaatgactaaataccctagaacttaagggattcaaatatttcattctgtgaataagggtcatgtatgtgcacacaaacacacacgagactcaatgaaagtagagttgctaacacatatacaactattgactactctgccttgtttactctgtattaaatgtttaattaattcatatatgcattcattctgtaattattgaaggaaaacctactgtggccctggcactcttctagtgtctaggaatgagcagcaaacagcagccaattcatgaactcatgaagtttacgttctagtatggaatttaaaactataaataaagaagtaaacgtcaaatagtgataagtgctatgggaaaataaggaatgttcaagaaaaggtattatatatattgtgaggtgccccaataataatatttaagctgaagataagaaatgaaccatgtgccttaatggttgaagggtaatataggagaaggaggaaacagaagttcacacggtgaagaatacctagtgtgttcaaggaacaacaaacagtgagtggctccaacaaatgtattaacattcaagaaaatgacagaggaataattataaagacataatcatagagtaaatattttaataaagtttaagctcttagaattctggacccatttcccatttactctgaaatgtgagagcttttttttaagctttggcacatgcatgctatataaatttggatgttaaattcaaatcactagaaaccttatttaatcacatgtacatagtccacttccattaatcactatgaatttaatagttatcttaaagctaggatggtttgaaaaccctcccacccacctagagactctaactctttcccctttactctcgtagtttccatggttctcaaattttcatgtgcataaacattactatgcacaattgtccacacaaagttaagtttgaaaaacattatgttatgcatagccaaataaacacgaattttttcaatacatcactattggattgttttctttctttagaatttcactcccaaataagttacaacaccattgtagtgaattgaaagagaaccacttcttctgagatagtgtataaattttttgcctataaaaacttaaaatacatatttaaattagataaccaaagtatgtcctcataagaattttcatgtcaataatatgaagatattcttaatattatatcttagtttattaagtaataggtaaatattataaaaacgaaagatgagtaaaaatcagtgagttttaatataactcacaataattacaaatttattaaaaagacatgaattttccctcattgaatgttatttaaataaaaaatataacttgcagataccgtgtaataaaatcattgctatcgctgtagaaaacaaacaaatttaaattttactgcaagacattggttgtgatgatcagtaaacacagatgctgtcactggcatttcttagggtgggtcactttgtagtgtaaaaatgtaatcaagaagtctactgccctgtaaccaatgaagaaagtggggaagcatgttttctttcagtggatttttttttctagtggatatttactgagaaattactatgtgcacatggaccactgcactatatactgaaaacatctctaacttccaggagctcattgtgtagtgcaggacaacaggaaaacaataggtcacaaggcaatatatggacagatgaatggagtgccttgacagtaaaatgatcctgtatttttttctttcaaataactagtggatgtctctctttcatatatttgacctattgatccacagatatgactatgagtgagaagcaggggaaatctgtaacaccttttatcatcttccacatagctaccattcctattagataatgtgggtcttccttctgccaatgtatctcttatattttgtatcctcatccctggaacactgttgcacatgaaagtggactctaaagaatgattgataaattgaatgaattatcatcttactcttgatcatatttctatgcttgataattgtttgtgttcagaaagatacaattgatgaccatttctatattaaaaataaaagtcttacttatgtgattttcctttcagttatatgtctcttctctcactaaattttattgttttagagtgcattttactagaagtacgtaatgaacgcataagtgatatttatatcaagaaacttttatttaatatccattcagttcctgagacaatggtaataccaactcttacaaaacattattaaaattttatttcagatccatttatattgctcagaaagcacattggaattaattcaaaaccaatctaaaggtatagtctctaagtaaacaattagctaggccttgaggtgagtttaataaaatgacatctctgtaaatatggatatagtacagtagtcttttctaattatttacatctaatgtaacatattatatgccagataactgctttttttccataaatgaagtcttctcttttgcattaataattatgactgactcaggttttgaccaaattcttattgatatctagatacattttgtcagtatttgtttatcagtggttggttatcatacaggatgttaaaaagcaagtgtttgagaatatttagttagtaaaggaaaaaataatcttgagctttatttaataatatatatagaaaatatatatacacatttatgaaaacaaaacattgataatgtataatacactgatgcatacacttcaattatttcctatattggcatttctgtctcattctttgtcattagtcatgaacccaaagctttttattatttagctggagaattagtttcagaattagattctaagaggccaaaatgaattgtgtctcaaatttttgattcaatgttaatttatttcttgttttgttgcttttgattaacagaataaaccaaattttataaaagagaaatatatcaaaataaaaacagggcataactcctcatttaattatgtcttcctgtgtttgtaacatagtgtaatagaatttattgaacagagaaagcctattaactctgaaaaatctccaattaagcacaaaaacagagactaaatttcctaaaatataatcttatttaattaaaaaatttttttgaatatctaacaggcatgggaacttgattctcctaaataaagtctgcatgtacatatacaatgatacaaattgttcatgaataattattatataaacataatttgaaagcatgaattatatatacaaattaactgaaagttattttctaattttatagcttatttatatatgtccatacagatacacaaacatgtatacatacaggtatgcatgtatgtatacttattatcaatgaattattattgattaaaagctctaaataaatgtacttgatggggaagactttccaaaataaaaccttgaagacagaaaattttcatatccaaaaactgaagtcagtaattaattattctgtttggattatatcctgtatgttctttgcccttcttttttccctcctggttctcatagacatgtttttgctcttcagtaagaagatattcataaagtatatcagattaatatttcaattagtttgcatactcttaagtctatgcaaactaattgtaacattgtataaatctgatttttctttttttgcatattgggatccttaaaaagcagcagtggcccaggcttctacccagctcaggttaaccttgtatatcagctaaatttgcattatcagggtaatgcaaataagcaataaggcttaaatttttccttctttcagaaattttgacaacttaataatgtcagaaaccaaggaagtaagaggtaaaattttcatatcaaattcaggacaattatttaggaggtgaggtttctcagcaacttgccagtgtaacaccagaaagttacctctaggataaacagttaaaatatcttacctctagaactcccaaactggtatagatttgtcttgaagttaatactattacctacagtcagaatgctttaggttttatgctgctgctttttttttttagaaaagataatttcataactatttatttattattttgtataaactattcccttgtgtaaccccccaaaatgtaagcatgcccaaactttgtactttgagtcttgtattgaacaaataaatacctatgagttactctaatttagtttaatttataacaaattattttaatgggagaagtgtaatttttattagaataacatacactttattagcatttatgcattaatagttcttaaattcacctggtgttggaaagagtaaaatgtatttcacatttgtagctttttctgatctgaattgatttgagagcagaattctgatttgagaaactggatgaatgaatagctaacatatctgttaatgtagttctctggaatatcaatcatttctatagtactctttgcaggacttggaaaaaaacaatgaaatattaacattcctgagtgtacctaaagtgaaagaatactgggtggatgattgaaaagatatgtgcattatttagataaaatcaagcatctggaaatgtagattgttaagcttttgggttggagttacaaaaatttaagagcctgacatattttagcactgatgaagtattatccaacttttatgcttataaatactattaaaaagcaaagctaagcttttttttctttctgaaaaagcgattttgagtatgttgaaataatatgagggatgttgcttggaatagtgtgagggcaagaagaatcctctattggaatataacattagggagaaaaaatctgataaggctactgaaggttgcttcattttaagcacattgcatttttatgtccttactggatgagtttgtaaaggaaaattatatattttcctctaaatagactagcatggcatttagttttttcaaaaatatctaatatctttgtcaccatatgctgacaaagacacgactattttaactaaacttctctatttcacgtatttgtgttgttttcatctgagttagacaggaataaaaaccaaactttgggagattcatttttggaatgcctgtgtgcagggctttggtgaaccagcttctcaataaaacaaccataactggtgaaaataatgggtaaaaaacataaagtatctggaaattgtcctaaaggcatacagcaaataaagaaacatttactcaagaaaatccgcaaaatctcgtaagacaataagagcatgtagtacctgtgtcataatctgttcttttccttccccagctcagcataatagaagctttactgtaggagcccatggccaagaagatggggcatgctctccccaaggtcccaagcaagggctatagcactgtattactttcctagggtgactgtaacaaataccacaaacttagtggcttcaaaaaaatataaatttatcactataaatacagttctggatgccagagttcaaaactgagggatgggcaaagctgcacttcctctaaaagctccaaggataaatctattccttgccttttccaacttctggtggcttcagttattttttggcttatggccatatgtttccaatatctgtctctgtacccatattgcttcttcctctgtggctgtcctctgtgcatcatttataaggacacttgccattggatttatggcccagccagataatgcagcatagtcttctcatttcaagatccttgtcttagttacatctgcaaagatcctttttctaagtaaggtaccattcgcaggttctggggataaggacattgacatatcttttgagaaccaccattgagttcactatagtctaccctctgagccctaaaaatttacatctgcctcatgcacaaaacacatttatcccattccaacatcctacaaagcttcaacgtattaaagcagtaactctatgtccacaatctcacctaaatatcattagcttaaaagtcccagatgtcaccatctaaatcaggtatgggtgagacattgagtattactcatcctggggcaaagtttctcttcatctgtggacctctgaaagtagaaaacaagttatttttaaaaatacaatggcaggatagggataggataacagttttaaatatttccacttcaaaagggagaaaaattaaggaataaaaggatcaccagttccaggcatgttcaaaaccaacaggccaacttcagttagatttcaaggcctgggtataatcctctgtggctaggggttctgccttctgggctcatgatttctctagttaggtgaaatatggagcatggcagctccataagcctctatttgagacagctctatagcttctgaccccagcagcacttctgtaagcctttgtctctgtacctttagtggctcagtaggtctctgcctttgtgtttttgcttttgacttctgcacctatgaatatgcttccagcctctgccttagtgctgtagctccataggcctttgcacccatgtctctgtgggtctctgcacctgtggcacactcatctgggtatttctcgaagaacagaaaatatttgcagccaaatagtaatatcaacctgtttccatcctgtagagttttggaaatctgacaactttcttcattttgtcctctctctgtccctgtcagtccaactgatagtgtttctgctgatacaatattttcaaaaattttgtaggtcttctgtgtatgtcatggggagtcacacaatgagccaagagggtcctccacagatatttcttggattatcccatctcttttcctggcttctgctgaggtgtttgagtggatttataaatcttataaatcctataaatgcttgtctagccgtccattttgctttttctccagagcacactttcctaacagtgaggttaaatttagtgttctttgcaatctggctaggctgaaaaatttcccgttataaaatgctggtttctttttggttaaaattttctctctcaatttgtcttgttcttcctacattttactgtaagcaacagaagaaacatggccacaccttcaacactttgtttggaattctcagctaaatatctaagcttatcagcttacaagttctgctttctacctagctgtaggacacaattaagccatgttttctctgactatataagaaagatcatctttcttctttctccagtgacatttttcttatttccttctgagcctttccccaaagcacccttaacattcgtatttctactaacatttagttcaagagtatatattaaaagtattaatggggaaatagtatttctttcttagcttgtttctcttgctttcatttactcattgaatagctgaggcaagaaatagcaatcaattctgtcttgtggacagtgtggaaatcttgggggcccactgctgagggctattttctgttgtcattaaggattggctatgattttgcagagtacctagtagggagttggtggcaatgcagatctgttgaggggaagtgttaatatttacttagcgactaaattcgaacaaatcaatcctggtaatttgggtatagtacagtaaaatgtaattgactggccaatacttaatctctaggatataattcaaaataagtactgtttacaaattcagaataaatgctatttactagctgattacatggaacgtctcatgagttaccttactcctctaaatcaggaaaaaacaatggttgctttactctgagagaaatgaatgaactaagaaggcttgctttcttctatataggactgggaggattgtttgaagttataaataagaaaatactctattttttgaccaacagtattatttttataaggagatttaaatgccaatatttgctgaaaattttggtatatatacaaacagatactaatttatagtatatgcaaacaatatataatttattagcataaatttactaaatatcatatttaatttcatatatattacatattatatgtaatcaagtcccaattatccatgcctccaaatagatcatctaaagcctgagtagaattaaacctaattattggaaatatacttctaattacttgggccatggtaggccaggcattaattgtttgaagtaggatgatttagaagttttttccaagattaatctgaaaactctaataatgcttctcagttttacctctggccctacagacatgattctgtctaaaaaaaaaattaagaacaatgattttctttcttttattattcctataaaataaataaatattcattacaaattagaaataaaaatgatcattgtaaaagaaaggtgagccctaatccaagtgcttagagataattaactgaaagcattatataattttccaaaaatttctaaccatttgactaagatccttattactatttcttttcctgtttcctgacaccaattctcacttatgctgacagaagagtgattgaacatggacatttgaaaataagcaggctaaagagaaagttagggctgtgtcttcaagcctggccagctaaataattataagtagggtcacggaccaagataggcacaggagtggaattggatttcattgtgcagactggtagggagggtagaatattaaggtgagcaaataaagcgagtaattcaaggccttgcaacttccatttctggttcttgcctcactcaggagactgcggaattgagacccatgagtgaggtgaagcagtgagttatgtgaagtattctactcaatatcaaacaaatgaatgaaacccaagaataagaaccttacacagaagaagctgaaaatacaattaattttcctctcttgctcatcaaataacatgttgtataacaccctggaaaggaatggcaaagtacaagtttacagtatacctagttattccttgaatttattcatttccatatttacagacataatgagataattgcaagcttagagggttgactctagttcttcctggggtacaatacgcaaacagcttgtttatacagttcaagtaccttattaagtggagaaggtaactgtcgtcttaaatgtgatgtgaagacattaataatccagttaactaatgtctaactttagttaacaggagcttagctgtgaatagaaagacaagttgtaatacatagataaaagctggtgcttaatgtgttaaagctctgtctcttgttctactacttatgtattacatactatagatcatggggaaagtatgtaatatgtcatacttgcttcctaaataatattaattcacctgatagatatgtatgagtatctacttatgtaagacaatgcaagacactgccattgatagtttttttgtataatgctttacagttttcaaagtcatttttttaaccaacagtgtccaccaattgaataataatctattctcttaggttcttaatcaaattgtccctaaaatgtcattgggaattttgttatttctgtgatatatcacagaaaatgaacataggtgcagacaaatatttctgtatgtaatgtactgggtccatgtgtccttgggtcccctttatctatctctggaccttcatgataagaacatctgttttacaagagttgggtttctgctctgccctccagacactaggatctatgcacagatttttttttttttttttttgagacagaatcttgctgtcaccaggctggagtgcagtggtgtgatctcagctcactgcaatctccaccttctgggtttaagcaattctcctgcttcagcctcccaagtagctgggactacaggcacacgccaccacacccagctaatttttgtatttttagtagagatggggtttcaccatgttggccaggatggtctcgatctcttgacctcgtgatccgcctgcctcggcctctcaaagtgctgggattacaggcgtgagccaccacacctggcccaggtatctttttgcacctagtcattcatattttatctcataaaggaaatctaaaggacagatcaaagaattattagctaaaataaatcaaacccatagtgtataaaaactattcacaataaacatttacattaataaaaatgtgtgtatttgtgtgcacataaaattgacaatacaggaatacattttaaaagatcaccaaggttttgctttttaatctttatttagttatccattagttcatacgatattcagaaagctcatgtggagtgaatagtacaaatacgtttaacaccagtttcttgaatgagaaaatttaatgttcaaagcttgtgaggtagatatattcaagtaatcagtggtcacttgagaaaacagagggtttttaaaaaatctttgagccatattgttacatcaactgtacttttttcttcctcttcatgtttctgctaatctgtgccatcataaagtagaattcatatttctcaatctaaaaatgcttatttatttattttctaaaatatgacttaactggaaacacaagaatacttaaataatgggaaaaatgaaagagatttcaaagttgattagaatttacatttgccttcatttttaagataatagattcatttgtcagtttagaggaattgtgtttcggtagtaagatataaaatgacatcttattactaaaatgatttatcactgtttattttatatttctcctgatagatctcacgttgctacacttaatgggttttagtacaacatttatttaatttggagttgatgtttgtgttaagtaaagattgaggtatggcattatgtactgttttggtttgttttacagatttacagcactagttaacctataaatacagaattaaacaaaggatagctctacaacaaattaaattttaattcaattaatatatttacttaggtcatctggttacatttaaatttgagcaaagagcttcacttagcttcattactacataacttcctgtctaatataacttacagatttttcaatgtgtggacttcttaaaaatttattgtaatttttaaggggatggggtagaacaatgagaaaaatgaaagggacaaaaatattaattaatataaggtaatataaacatgaactaccaagtcaaattattttctgatgaattcaatcaacataaaaaataaatcagaaccacccaaggaccccaaactctgctatctccgtgtatagatgtcttaaaatattaactctttttttgtattccttttgtgtgtttgtttttttaaatctacgctacagccaacagtatccacatattaggtgtttctggttatcttcatcttgtcctgagttagtttccatctggtataattttcctttagcccgcctagtttcctttagtttcatttgtaccgaaaatctgctggcggtgaaatgtcttagtgttgtttgtctaaaaatatctatacttttattcttaaaatatattttctctggatttaaaattatgagttgagggtttttgcttgtttgtttatgcagttgttatggttggttgttttcccctctcatcatttttaagttttctcatgtcttttagttttcataatttagatgtgaaatcagtgtacattcatataattgttccactgtacgtagtacctcatttttcttcagttgcctttatccttggcagtttgactatgtagttcaatagtgggctttttggatatatctttatttattttatatgcttcttcaatttgtaaatatttttcaacaactttgggaaaattttgactactatttcttcaaataaatactcgttctatattcttcattttctccatctaggactccaattacatgtacaagagagctcttcatattgttacacaacattttattaattaatgttagtcagagagatgaatttgagactaatctcccatcttgttggctgcagcaccagattaaagccttctttcctggcaatactcactgttttagtgattggatttctgtgcagcaagtagcagggcctagactgaacccctggggtttcagtaacactttcctttcccattactatggggaccctaaactttgccctctatttttttcaagccaatacttcctatgcaatactgcatacgctgtatctgaattttagccaccccacatggcagtgaccagtgcttatcctcagttaaggagatgtagaaaaaagacctcactcaatgctgttctctttttccaaatgtcagccatacttcaggttgtctcgatttatggcataattgagtaattaaatttcatgagaatttaattctcctgaattaaatacaattttattacatcaagaatattatgaattaataaagtgaatatttgatgatttttcctcagtttcccagcagttacatagattaacattttattctacttgattatatttttaaataaatatattcaatatattttgcatgtatgcaccctaaggaaaaaaaattgccactactttttagctctatcagcaataactatcaatcttaagtatcatattttattgaaggtcaacttgctgtagttgaatgagaaagtaaccatttattgtttttgcctcagggaccttcattcagctgaactaatgcgactttaacagtgtgaggacagagatcatttactaggaaggacccatttattataaaatctaagaaaatgagtttattctatcctttattcagagtacttgaaaagaatttctcaaatgttttctagtttatatactgttaccatttataattaaggacaaataagagccatgtgaagattaaccagactgctttagtgataatttttctggggccactagagaaaagctaagaggaccacagtgaagtcatccccactatctgttcttacagaaagttagctcacccaatttttctgccaaaagtggaaaataccatacactatatgtcatccacccataaagatccataattcatactagtatatggcatagtagggactctggaaatgttgggtaagaaaacctgtttaactgtgcttagtttagtgtttcctaaacatatttgactacaaatttctttttcacgcatgaagggatatagttagaattctttaggtaaaccctaatgaaacaaataggcaaaactgattattcaatatgttaataaaacctgatatcttgggtgattaggtatatcaatgagaagaaggagcctactctataaagttgaatagtctaaactttgaggaaaacggccctctcaatttgaatgcttctgggtgcttagcatatgaaaaccccatttaggtaacttaaagcaaaggaagattttacaccaaaccatcttagatctgatgacattagtaagaaaagcagtgctctgaatgtgggtctcctttctcttcattctctatgtgtggatgtatgtatgtaagtatgtgtctggcatacaaaagaggaatcatttgtcaagggcaatctgtgagttaatgtgaaacaaattaacacagggaatcagtaaatagatgatgatgactgatgttaactgagtggacaggcttctcaaatgtattatttgggacctcaaaatgggcggccagtttatttttgaaaatctcagccagagactatcctcttcattcctgtggtataaacctggtgaacctacttaagcattccttcttctgcagaaagaaagatgatccttaatataatcagtctcagtgaattatatggataattctagcgacagtttattctaagaattctcttcatttctgccctctcatcaagatgttgctacaaaccccaaggccattgcctataattgtctttcctccttgtttattctggcaatgccctaaaggactcagctcttataccacctcttctgcaaaacattaacaaaacccacaccaacagaattaattgctcattcctttctgcctccttggcacattctttatctgttcatattgccttacagctgtttgttcatttactgcaacattcttgtgggttagagttttgacatattatttcgatctagcttatttttatatatagatcaggtccaatacatagcagtattaaataaacattggttaactgaatgagaaataaacatgggggcttttttgtttatttgtttgttatttttgttacctcactctagtctatattcaaattgtaacactgtcagcttcctctttcaagatatgcttatctgattgttcctcaagagaacactaaaaatcttggcctcctatttaaaaaaaaaaagagtatatgggaagaagacatataatgaatcttctcaggctgctataacaaaataccacacactgcattgctgaaacaatagaaatttattttctcacagttctggatgctgaggaatccaatatcaaggtgacagcaaattccatttctagtgagggtcttcttggcttacaaatggctgtcaccttgctgtgtgctcacatgagctctctagtgtctcttcttataaggacactaatcttattggatcaaggatccattcatgacctccttttaccttaattactttcttagagaactcatctctaaacataattgcactgggggtcttcaatatatgagcatgagggggtacacaaacattcaatccataacaagatatttgatgtttcctacccgtcaggcactatttgtttaatttttgtttaatacagattattcagaatgaaagaatgactgcttgtgactaacagaaagtctttttagtatgtcacatcactacagtattatttcttgggttttaaaaattatcctttacacagtattttcaatttgagaaatattttgggtagtagctgtttgtttttttcattttatctagaataggatgccatattttcttgagaagataaatgcagtgggtattagttgcagtcaattccaggaaaactgttaactggcacaaaacagttaggagcagccagctaccacttcataatcaatcctgcatacccaccaagccctccacctgtggaaattggcatttagatggcagaataattaaaatgaatgagaaacatcagtgttcattgtccatatgctaacggtcatttctctctgtgtgtgttacctagttatttctttaaaggttgtatacgttctctgtattgttgcaattttgttcaagatttgaggcagccaaagggctttagtgggataacattattgtaactacctaaagaatgaaatgattttccaacgtagattcctgattctttgtggtaacttgatctgtgatatgtccagaaatcttttaaggagtaaagattggtatcagtggaatgtttaaatgtgataaaaatgtgtaaagttaataaagttgttggcacttaataggtaagcaacaaatgcaactatttccatccctcaattacatacagtattttgatacctggggaaatataaaaacaaacaaaaaatttcaactggttattgttaaatcagtttttaaagtaatcactcttgtagataaagcaaacactgacaatgaatcttttcactgtttataaaactttgtagaactgagcaaataccactgtcaggtgtctagtattacaccctttatgaaatacccttgttttagcacatatctgggttgatatgtgttaatgtaaccaaatgtcctatcttggagtcactagaatatgaactttataaaaatcaaaacaattagcatttcactagataacaagagtttcatatgttggtaagaaattaatcttttaaagaaattctgaaatctgatgaactcatataatctctaaatctgggtgtgtcctctgctttgaacatttatgttaatttaattctgtataatttaattagaatgtaagaaatgggatagtgacctataggaattatgacacttgatgtttaaaaaatcatgagataaacaaggagtaactatcatttaaaagcattctagtgacatcttatgttttacaaatttttgtactactcattttcaagtaattaattcataaaggagagaggctttttggactgattaagaataggataaaacagatttttgtgggaaatatttaatacatggtgaagaaatttaatctccttcaatgttattaatattgtctcacacagctgtctctacgtctaaacttttgagagcaaattgagctgtgaagcatattatgtttagaattaaaagatttggttctagtctattctttcggtgacagacttgttagttttctcacatttaagttgggtgtgataatcacctattctaattacctcaggtgtctatataagagtcagggatgttcaaagagcacaaacaaaataatatataacttttctattaagagggtagtaaaagagcccagctatttgaaactctaaaaacatttctgtttataagtctccctacatgtttcttagatgaggtttagtttggactttcccaaacctatcttcacttgcttttcacaaagttattgtactgcttgttgctcttaaaataaatactcataatgccctcagaatgacttttaaaacaataattacttgcattttagttttcttacattttattattcttatgtaattatgaagaaaagatctgataggtttttaattttgatacaagttttgggtttttgctttgttttttttctccttctgttgttatgttaaataacagttttacctatggaatttttcttacattttgcactatagactgaatttgagatgagtcattcccatctcaaaaaaaacacattaacatgttgaaaataaataagaaaaactgctagctcttagttaatatagaccagcacttaacaacatgctgagtctattatggaattggcattaacacagaccttgaagtctttcatgtcttatagttcctatggtgaggtaataaatcggctgtgtgttagatgatataaggtatgtggaaacgaagttgcaaaaacttacaatggattacttatggcatctgctagatgcagagaatattttaattcatttaatcatgaggctatttttctgactagaaaatttatttttaacaccttttaaaaggagtgaaaatagatttccagatactaatactgaaatcccaatagccctctgcaagggatagaaaggttcctttctaaattttattgccagtaacaaaatatttcaaattaccaaacgtaaaatctctaaatccagtgaaatatagtgaataaattacatagtgtttcttagggaaaaaagtaaacatgtatgatactttttatagttacaaagttttccagataaaatacttctggtaaattcgtgagtttccaaaagacatccccaacttccattactcagattagtcttataacattggcttctctctttggtattaattgtgttccacaatttgtaaggcattgtgggggtgtattgcaagcctggtaggttaacattaaatctctgtgtgaatgtggtattgtagctatttgttagttaataattttcatattgtattaagtgattagtgatagaaaaagttaaacacatattcatcatttaacctggaatttccaaaaataatttacttctttggtggttttcttagtccattttgtgctgctataacaaaatactgcacactggataatttataaagaacagaaatttatttctcacagttctgaaggctgagaggtccccagtcaaggcactggcatgtggtgtctggtgagggccttcttgctgcctccttatgtggtggaaggcagaagcgcaagcagggatgaacactgtgatctcacattgcagaagagtgaaagaaaaagagctcactcccacaagccctttctacagtgcaattaatccattcatgaaggttgagccctcataacctaaagacttcccatctcccaacattgttactttggggattaagtttcaacattcgttttggaaggaataaaaaaattcaaactattgaattctgcccttggcacccccaaattcatttcatccttatacacaaaatacatccattccattccagtagcctaagtcttaatttgttacagcatgactttaaaattcccaaatccagagttttatctaaatcagatatgagtgagattccaggcatgattcatcctgaggcatattttcctccagctgtgagcttctgaaataacagaatttatatgcttccaaaatacaatgatgagacagcataggatggatattaccattccaaagggagaaataggaaagaagaaaggaacaacacgtcccaagtaagtctaaaacacaagagggcaaactacgttagatcttaaagatccagaataattacctttgattctatgtcctggacacactgaaataaagtttagggccccaaggcctctgtcagacctgcttctgtgactttgctgggtgcagctcgtatcactctcataggctgaagtaaggtgactatggcccttccaggctgatgttgcacacatttggctccacaattatgggatctctggggcaccctgctcccacgactccactggacatcaccctattgagggctgtctgtggcagccctgaagctgtttgagatggcctttgaaatctgggtagaggaagctatttctctataattttgtgtgcctacagaattagcagcatgtagacaccaccaaggcttaccacttccaatctctgaagctatggcttgagccacacttgggtatgcctgagctacagctgaaaaagccaaaaagcactgcattggaatgcagacagcagcaatctaaagtggtttctgggtagtgagactcaaggtcacacatgtgccctaggatcttctcttgaaaactttctgccctcaaggccctgtaactctgggcatgtgatgggcattggagcctcaaaagactccaaaatgtcttcaaagtcattcctccattgttttgatgaatagcacctggattccttctacttatattaatatccttatcaaatgatctctggccacacccttagttttgtttgtttgtttgtttgtttgagacagtctcactcttgtagcccaagctggagtgcagtggcgcgatctcggctcactgccacctctgtctctgggctcaagccattcacctgccttagcctccctagtagctgggattacaggctcccgccaccacgcttggctaattttttgtatttttagtagagacagggtttcaccatgttggccaggctggtctcgaactcctgacttcaggtgatccgccagcctcggcctcccaaagtgcttggattagaggcatgagccactgtgcccggcctttttttttttttctaaagttgctttttaattttttttacatgactgggatgaaaatttttcaaaatttttgtgttctgtttccagtttaattacaaattccctctttgttcccagttcttgaattttactataagcagctaaaagaagtcatgcaccatcttcaatattttgctgtttagatatttcttctgccaaatatcccagttcattactcttaaattctgccttctacaaagcccttgggcttggacaaaattcagcccagatttatttatttatttgtttttgccactttacaatgaaagttgtgtattagttaggcttctctagagggccaaaactaatagaatagatgtatatatgaaagggagtttattcagtagtattgacttacatgatcatgagatgaagtcccacaataggccatctgcaagctgaggagcaaggaagccagtccaagtcccaaaacctcaaaagtagggaagccaagagtacagccttcagtctgtagctgaaggcccaagagccccttgcaattcactggtgtaagtctgatatggtttggttctgtgtccccacccaaatctcactttgaattgtaataatccccaagatgtcaagggcggggaccaggtggcagctttccccatactgttcttatgatagtgagttctttcgagatctgatggttttgtaagtgtctggcatttcctctgctggcactcattctcttgcctgctgccatgtaagacatgcctttttcctcttttgccttctgccatgactgtgaggctcccccagccatgtagaactgtgagttcattaaacctctttttcctagtcttgggtatgtctttattagcagcatgagaacagactaatacaaagtccaagactccaaaagctgaagaaattggagtctgatgtttgagggcaggaagcatccagcacagaaaaagatgaaggccagaaggctcagcaagtctgctctttccaatttcttctgcctgctttatcctgctcacacaggcagctaattagatggtgcccacccagacagagggtgggtctgctcccccagtccactgactcaaatattaatctctttggcaacaccctcacagacacacccaggaacaatactttgcatccgtcagtccaatgaagttgacactcaatattaaccatcacagatggcttttcctccagttcccaatgtcttgttcctcatctctgtctgagaccttatcagaatggcctttactgtacatatttctatgaacattctgttcataatcacctagaaaaacttctaagaattaggctccctctacagctatcctcttctgagccctcaccagaatcacctttaatgctctgttcatggcaatataggttttttctatattgttccttcaaattatttcagcctctatttattacccagttccaaagccacttccacatttttagttgtcatagcaactcccaactcctggtacccacttctgtcttagttttatgttgctataacacaatatgacaaactgggtaatttatgttttttctttatttcttctaaaaaagaataacaggatatatgtacagaatgtttaggtttgttacataggtatacgagtgccatggtggtttgctgcacatattgacctatccactaagttccctcccctcacccctcacccccaacaggccctggtgtgtattgtttccctctctgtgtccgtgtgttcttaatgtcaactcccacttatgagtgagaacatgcagtgtttggttttctgttcctgtgttagtttgctgaggatgatggcttccagcttcatccgtgtccctggaaaggacgtgaactctcttttttcatggcagcatagtattccatggtgtataggtaccacgttttctttatccagtctatcattaatgggcatttgtgttgattctgtgtttttgctattggaaatagtgcctcaataagcatacatgtgcatgtgtctttacaatagaatgatttatattcctttgggtatatatgacaaactgggtaatttgtaaagaacaaagacttatttctcactgtccttttaaccactgagaggttaaatattaaagtgctggcatctggtgtctagtgagggccttcttgctatggatacaaatgttatatcctcatgtggcagaaaagcaaaagagaaagaacccacttaacaagtcctttttattgtggcattaatccattcaagaggattgaacctcactacctaaaaatctcctgttaggtctcaccactcaacattgttgcactggggattaaatttcaacatgagttttgggagggacaaatacattcaaaccgtagccatagtaattatttccccacaaattattaccaagtactctgttatctagtgtctactatttattttcaatactgaaaaagtgtgatttgcttttatgtttactataataattaagaataaggaaagagtccattttttgaaatcgttctcatttaacacatttgggctaattaaatgaaattctcaatgctagtcttttatgaacaaaaaaagaagagaatatttgagtgccccagtggaaaaaatatggcaaaaataaaacaagggaaagaaccctctggctattttctcactttctttctcaagtcagtttatccttatgtcactttcctctgatcctgcttataatgttgtctctgtagaacacattattttagtctgcccagaacatttctctctccttcttgtaggttggatatgtgacataagtgaggtgagtcatggctagcattcattaatctggccaaattgccagtatgggagtagtcacatgattcaagttaggaaaagcagagttctgtggggtttttctaagtagaactagcaggaagaattctctcttctcttttggatatcaagtattaaatgtagtctaaaaaacccttcagggagcaagtctttttcatgtgacaaagcccaagaagtatacaagaagcagaaggagtcttacaggaacaaatcctcagattcatactctaatgcctctgagatgcccggttcctgcagttcttcctttaatttttgcagctatcttatatccttccaatccatcccatgtttagattaaactattttgaatttagtttccttcatttggaatggaaaatatctgcttgaagctgcatgttcaaaaagggaatgtcaaaggatactgtagtattcatactttatataccttctttaaactgcacctcagcgattcatctgtaccaaattttacatcaaaatcaaaaatctccattgcacagactcatttataactataacgtgggtgttgttgggattctccatttgccttctctaacattagactctgctacacaatgatgcaatgtatgtttagttttttctactgcaaagactgaatctctagaattgtttttccccttgctcttgagagctaacagaatattcagtgtaacttcttgcccactttccatattcatatgataatcagatatttgccctgttagatcttctaaatttctaattaatcacacagtttaacgtacaaagaaaatttaaaaatgctcccaagtttctttttttaaaagaaaattattttttaaaatgtattttaagtatgctcttcttaaaatgttactttagctccatggagataatcctttttgattctattcatgttacatctacatgttctttaaatatctgtataagaactaccctttctagcactacctgaaatttataatttattcataaagcatttttatgatgtttttctttatgtttttgcatactttgtctgctttttttctgaagtaaaatattttttactgattataatgtgaatacataattaggcagaaaattaaagcaatagaagaaataataagagtaaaattttctccaaatcgaagcaggccattgtaaacagttaaactaaacacctttttaatttaaacttttgaggtaattgtagatttatatgcagttcttagaaattacagggaaatatcccttgttcctttacccagttttccccaatagtaacatcttgtaaaactatatattaatatcatgactagactattgactggatattttgacatgtgtgttgctagtacataaatgcaatttattttcatatatttatgtgaacttacatattgactctagaaggtatcttcttgcagattttttgttttgtttttatgtagataattatgccatctccaagtaagaacagttttattttttcctttctcatctgttcacaacaaagtgctaaattagatatagattttttaatgcctttatcatgttgaggaagtttctctctattcctgtttttctgagaactatttatcatggatgggtgctgactttttcaaatgctttttctgcatcaattggcataattatgtgatttttcttctttaacctgttgtggtgaatattgatttacatttgtgaatattgaaattaccttgcgcttatccctgaaatagacttgacttgatcatttggtcatggtgtttgtgtgtgtgcatgtatatatttatttatttactgtattagttcattttcatgctgctataagaacataaacaagactgagtaatttataaaggaaagaggtttaattgactcaccattccacatgccttgggaggcctcagcacacttacaatcatggtggaagaagaagcaaacacttccttcttcacctggtggtgtagcaggacaagacgcagacaaaatccctcagacactgagttgtagaaagaagggctttattcagctgggagcatcggcagactcacatctccaaaaactgagctccccgagtgagcaattcctgtcccttttaagggcttacaactctaaggtggtccacgtgagggggtccacgtgagagggtcgtgatcgattgagcaagcagggggtacgtgactgggggctgcatgcactggtaattagaacagaacagaaaaggacagggatttttcacagtgcttttctatacaatgtctgtactctatagataacataactgattaggtcaggggtcgatctttaactaccaggcccaggatgtggcgtcgggctgcctgcctatggatttcatttctgccttttagtttttacttcttctttctttggaggcagaaattgggcataagacaatatgaggggtggtctcctcccatagtggcagggaagagaagtgccaagtgaagtggggaaaggccccttataaaaccatcagttcttgtgcgaactcactcactatcacatgaacagcatgagggaactgctcccaggattcaattacctcccactaggtccctcccatgatatgtggggattatgggaattacaaatcaagatgagatttcagtggggacacagagcaaaaccatatcattccaaccctggtccctcctaaatgtcatgtccttacaaacacaatcatgccttttcaacagtcccccaaagtcttagctcattccagcattaatcccaaagttcaagtcaaaagtctcatctgaaacaaggcaagtcccttctgcctatgagcctgtaaatctgaaagcaagtcagttactttttagataaaatgggggtacaggcattgggtaaatatgcccattccaaatgggagaagttggccaaaacaaaggggctataggccccatgaaagtccaaacttcaacagggcatcaccaaatcttacagttgcaaaatgatctcttttggctccatgtgtcacatccaggtcacactgatgtaagaggtggactccaacagccttgggaagctcagcccctgtggcttcaaagggtacagccccattcctggctgcttagctggctggcactgagtgtctgtggcctttacaggtggatcagtggacctaccattttggggtctgaaggacagtgggccttctctcacagctccagtagagagttccccatttgggactctgtgtgtggactccaaccccacatttaccttctgcactgccctagcagaggttctccatgagggaccacctttgcagcaaacttccgcctgaacgtccaggcatttccatacatcctctgaaatctaggtggaggttcccaacctcaattcctgacttctgtgtacctgcaagctcaacaccacatggaagctgccaaggcttggggcttgcaccctctgaatccatggcctgagctgtaccatttttactcacgtccctgtgaagagaacaccaaacaggctttgtgtgagcaacaaggctgtttatttcagccaggtgcaggtgggctgagtccaaaaaagagagtcagcgaagggagataggggtggggccattttataagatttgggtaggtaaaggaaaattacagtcaaaggggggttgttctctggtggtcaggggtgggggtcacaaggtgcttggcgggggagcttttgagccaggtgagccaggagaaggaatttcacaaggtaatgtcatcagttaaggcaggaacaggccattttcacttctcttgtggtggaatctcatcagttaaggcaggaactggccatctggatgtgtatgtgcaggtcacaggggatatgatggcttagcttgggctcagaggcctgacattcctgtcttcttatattaataagaaaaaaaaaaaaccgaaatagttgtaaagtgttggggcggcgaaaatttttgggggtggtatggagagataatgggtgatgtttctcaggactgcttcgagcgggattggggcggcatgggaacctggagtgggagagattaagctgaaggaagattttgtggtaaggggtgatattgtggggttgttagaagaaacatttgttgtgtagaattattggtgatggcctggatatggttttgtatgaattgaaaactaaatggaataagagaaggagaaaaacaggtattaaaggactaagaattgggaggacccaggacatctaattagagagtgcctaaggaggttcagcatagccttgccagcaaagattatttatttacgttaagagttaagagtggcagtttggggatagcaccaggagatatcagctgtgatggcttggagaaacagtgtaaaccggcagtgtaaacaagagcagggcatgcaggagtagttgagaacagtgaataggagtatgactagagagaagatagtagggatgacaagttttttggggcacagtccaagttggtctggtatctggaatgagactggggcctaataaaaaggagcatccatacaggagcttaaatgggctataacctgtagcattccgaggacaggcctgaattctgagaagggcaagtggtaaaagtattgtacagtcctttttaagttggtggctgagattggtgaggtgtgtttctaaaggaccattagtccattctacctttcctgaagattgaggatggtaagggatgtaaaggtttcactgaataccaagagtctgaaaaaatgcttggctgatttgactaataaacgctggtctgttatcagactgtgaagaggtgggaagcccaaactgaggaattatgtctgacagaagggaagaaatgaccatggtggccttcttagaccctgtgggaaagtcctctacctatccagtgaaaatgtctacccaggccaagaggtattttagtttcctgacttggggcatgttgagtaaagctaatttgccagtcctgggtgggggcaaatctccgagcttcatgtgtagggaagggagggggccagaataatccctgaggagtagtagaatagcagatggaacactgagaagttatttccttgaggatagatttccacgatggaaatgaaatgagaggttctaagaggcggggtagtggcttgtactatagcatagcctgcctttgctggtgtgtggcgattaggcctggtgggaactgccatcaataaactaagtgtgatcagggtgaggaacaagaaagaaggaaatatggggaaatggggtgaatgtcaggtggatcagagagatacagtcgtgggggtcaggtgtggtatctggaataatgtgggaggctggattgaagtccgggccaggaacagtggtgattgtgggagactcaacaaagagtgagtacagctgaagaagccagggagcagacagtatatgtgtcaggtgtgaggaagaaaatagattttggaagttatgagaactgttgatcatagttcgtgattttaagggcctctaaaagtattagggcagcggcagctgccgcacgcagacttgagggctaggcaaaacagtaaggtcaagttgttgggataaaaaggctacagggtgtggtcccagttcttgtgtaagaattctgactgcacagtcctgcacttcagctgtgggtaatgaaaagggttctgatgagtcagggagagttagggtgggggaagtctctaaagctgtcttcaaggaacggaaagaggagtggggaaaggatttaggatctatggggtcagataggtttctttttgtgagtttatataatggttttgttaggatggcaaaaccaggtgtctaaagtcgaaagtatctaaccatgcctaggaaggaaaggagttattgttttgtagaaggtgttggggtttgagagatcagttggacacaatcggcagggagagcatgtgtgtttttatgagaattacgccgagataagtaacagatgaggaagaaatttgggcttgattgaaagaaatttgggcttgattgaagtaatgggggccgtctgtgaagccttgcggcagcacagcccaggtaatttgctgagcctgatgggtgtcagggtcagtccaagtgaaagcgaagagaggctgggatgaagggtgcaaaggaatagtaaagaaagcatgtttgaaatccagacagaataatgggttgtggaggggggcattgaggctaggagagtatatgggtttggcaccacagggtggataggcaaaacaatttggttgataaggcgcagatcctgaactaacctgtaagccttgtctggttttaggacaggtaaaatgggggaattgtaaggagagtttataggctttaaaaggccatgctgtaacaggcaagtgataacaggctttaatccttttaaagcatgctgtgggatgggatattggcattgaggggggtaagggtgattaggttttaatgggatggtaaggggtgcatgaccagtcaccaaggagggagtagaggtgtcctatacttgtgggttaaggtggggggatacgagaggaggatgtgaaggaggctttgaaatggggaaaagggtggcaatgaggtgttgctgtagtccaggaatagtcagggaaacagataatttagttaaaatgtcttggcctaataagggaactgggcaggtggggataacttaaaaaagagtgtataaaagaatgttgtctaagtgggcaccagagttggggagttttaagaggtttagaagcctggccgtcaatacccacaacagttatggaggcaagggaaacaggcccttgaaaagaagtaatgtggagtgggtagcctccgtattgattaagaaggggatggacttaccctccactgtgagagttacccagagcatctgtgattgtcctgtaggcttccaaggcgattgggcagtgtcagtcttcagctgctaagccgagaagatctgggaaggagtcactcagagagccttgggccagagttccaggggatctggaagcggctgccaggtgagttgaagagtccgattttcagtggggtcccgcacagacaggacacggcttagggggaatctcgggctgtgggcattccttggcccagtggccagatttccggagtaaaccttggcagctgcagttcaggcgtttggaagttcttgtgtgtggagatgtggctggggtttctttcacagtggaggcaaggaattgcaactcagaaatatattgctacttggcttcctctactctattattgtacaccttgaaggcgaggttaattatgtcttgtttgtggggtttgagggccggaatttaatttttggagttttatttaatgtcaggagcggatttggtaataaaatgtatattgagaataagatggccttttgaccttttagggtctagggctataaagcatctcagggttgctgccgaatgagccatgaactgggctgggtttttcatatttgatgaaaaagagcctaaatgctaactgattttgggagaggtcggataaagaaaaaggagcattaacctcgactatgcctttagctccagccaccttttttaagaggaaattgctggacaggtcggggagggctagttgctgaacgaaactgtaagctggaccgggtgtgaggaggggaggtgataaaagggttacagggtgggggagcagaggctgaggaagaattgggacctggcttggcctggcgaggagcagcctggggaggaggggagaagtcagatgggtctgtagaaaaggaagattacaaatactcagcgacccttagggttgggactgagaggacaggcgggagggaaagaaggaggatttgggactagtcgcattgggaacagagactagggaggcactgatgtgtaaaagaatgcctggatgtcaggcacctcagaccgtttgcccattttatgacaagaattatttagatcttgtaggatggaaaaatcgaaagcgcctttttctggctatttggaaccactgtcgagtttgtattgtggtcagattgcattgtagaagaaaataaggcatttaggttttaggtcaggtgtgagttgaagaggttttaagttcttgagaacacaggctaagggagtagagggaggaatggagggtggaaggttgcccatagtgaaggaggcaagtccagagaaaagagagagtagagacacggagagaaggggtcagggggttcttgtcccccagaaaagcggcatttgccgctaagggtgaaggaccaaggcaggcgtccccgcgtggtcagacacacctgaaatgtgtgtgaataatcaggcaggtatccccacgtgattaaacaccaagggaaggctgccttcccgagtctgtgactggcgccggagttttgggttcatggataaaatgcatctcctgagttgtctctaccagaaaagggaaggaactgaaattaagagaagggagagattgaaagatggtgccaagattgaaaggagaaagaggttgatggatagtgagaggttggagaagagagtaaaaagaggtcgcttacctgatttaaaattggtgagatgttccctggcctggtcggtctgaggaccagaggtcgtaggtggatctttctcacggagcaaagagcaggacgggggattgatctcccaagggaggtcccccgatccgagtcacggcaccaaaatttcactcgcatccatgtgaagagaccacgaaacaggctttgtgcgagcaacaaggctgtttatttcacctgggggcaggtgggctgagtccgaaaagagagccagcgaagggagataggggtggggccattttataagatttgggtagataaaggaaaattacagtcaaagggggtttgttctgtggcgggcaggggttggggggggggtcacaaggtgctcagcgggggagctttaagccaggatgagccaagagaaggaatttcacaaggtaatgtcatcagttaaggcaggaacaggccattttcacttcttttgtggtggaatgtcatcagttaaggcaggaatcgcccatctggatgtgtatgtgcaggtcacaggggatatgatggtttagcttgggctcagaggctggacaaccatgacccctttaaaccacagttggagcagctgggatgtgaggcacaaagtctcaaggttgcaaacagtaggggtgtccctgaacccagcccatgaaaccagtttctcctcctaggcttcctggcatgtgatgggaggggctgtggagaaggtgcctgacattccctggagacattttccccattgtcttggtgattagcatttggctcctcattacttatgcaaatttctgcagctggcttgaatttctccccagaaaatgggtttttcttttctactgcatcattatctgagtgcaaatttttcaaactttgatgatctgtcgcctcttgaatgctttgttgcttagaaatttcttccaccagataccctaaatcatctctcacgttcaaaattccacagatctctagggcaggggggaaatgctgccagtctgtttgctaaagcatggcaagagtcacctttgctccagttcccaagaagttcctcagctccatcttagaccacctcagcctggacttcattgtctatgtcactctcagcattttggtcagagcaattccacaagtctctaggaagttccaaactttcctgcatcttcctatcttctcggccttccaagtctctaggaagttccaaactttcccacatttcccctaaatgagccctctaacctgtcccaaactctaccttgtaaggtcagttgagagaaaggaagaatagacccgaagtcagatgagtaagtttattgaacctgctggctgctccaccacagacagcaggcagtcctgagctgtttataaacctgaggggtttatatgggggagacagaccctggggtcatttgttggttaactttgccatatatcaccttgtgacgtttgtggtagcagccagatgaaggaacttataggagggtataggtaaagtttgtttatgcttcccaggaccttcccctgtgcagtctagatggcttgtaattggggtttgtttattgcagcaaggcctggtaggtaaagtctgctggcctcacagcggtgcctagataagtgcttagaaatgtaaagggctgggggggaagggtgggcagagttgcagagcataagggggaggagtaggcagcacggagaggtttgggggaagtgttggcagtaccaagaagttttttggggtggtttgtccctaacatacctgttacttagttccaaagttgcttccacgttttcgggtatccttatagcgtgtgtgtgtgtgtgtgtgtgtgtgtgtctgtgtgtgtatggagagagagagctgaattattttgtagttttgcatccatattcatagggatatttgttcatagtttcattttttgtactatatctagttttggtgtcaagttaatacttgctttataatgtagattggtaagtgttctcttcagttttctggaaaacatttttctctttgttaaggtacacatttagtgcttcaattttcttctcagcatgagcttaactgtttcccacataaccgaatatgttatattttaattttcattttattctgctcaaagtattttttatttccttggagaattcctctttgacccatgaattatttacaagcattttgtttagttttcatgtggttggagattttcccctttatatttttgctatgaatatctaagttaattccatcgtaataaagaatatattctgtgtgatttcaattctttaaatgttttgctatttgttttgtggctgaaggtggtctatcatggtgtttcatgggcacttaaaaatatatatattctgctgttggtgtttattagtgttgattatcacttattgattgataatactgttgtcttcttttgtatctttgctgattttctgactagttgttttatcaattttgagagagctatattgaagttttcaaccataattgtggatttgtctatttttcttcatttatatcagtttgattaacatattttgcagctctgattagtgcatacatatttatggttgctatgtcttctacttgtattgacccttttattggtacataatactgacccagtgttccatagacagtttttaaaataaatataaaaattgtcgggctgggcaaggtggatcatgcctgtaatcccagaactctgggaggctgaggcgggcggatcacgagatcaggaattcaaaaccagcctgaccaacatcaaaccccgtctctactaaaaatacaaaaaattaactgggcatggtggtgcatgcctataatcccagctactcaggaggctgaggcaggagaattgcttgaaccccagaggcggaggttgcagtgagcggagatggcgccactgcactccagcctgggcaataagagtgagactgtgtctcaagaaaaaaaaaaaaattgtcccttctggtcttaaagcttgtaacttgcatttgctttattctgagtttcttccttaggaaaaagaccttcaatcctcttgaaaagtatcaaagaactgaaactcaccaaatcactgcatccagacaatgagatgccagatcctacattcatcatgattgcttcctttcccctccctagttcctgttttattatacatcattacatttcttccttgctatataaacccctaattttagttggtcagggagatggatttgagactgacctcccatctccttagctgcaacatctgattaaagccttcttccttggcaataatcattgtttcagtgattggctctctgtatggtgagcagcaagacctagaccaaacccctggtgttttggtaacaatatctgtttctcccatttttttttggttatgaagcctactttatctgatattaatatactcattaatgctttctttcattagtgtttttctgatgtacttccacagtatacattttactctttttattttttattagctgcctatcatgttatgtttaaaatgaatttcctatagacagcacacaattgtgtaattgtttttttaaatctatctacaaattcctgtctttcagttattatatttaaaccatttttatttaatgtaggtattaatttggtagaacttaaatttaccatttttaaaatttagtcttgttttctatttgttctctctgatttgcatttttctattttcttttttctgacttcctgtggattacttgagcatttttaaaattccattttgtcttatggaaagtctttggaacatcattttaagaatttctatgtaaaaactgcatacatggccaggtactcacattcatgcacatgctttgatatgaacagcattcaaagctataacatatttttctcatttaacaattaaagactcttccccatcaatcaatgttaatatttatcttgcttttcaaacttttaatattcattgcttgagtgtagcttaacttagtcaagtgaaatctcagttattaatatctagggagttccaaatgtgtgttattataaacaatactggataaaaaaaatcctcgtgttggtttctttgacattttgagttttattactttttgccaatgtttcgcaaaaaattcatttactttattttatttataattgtggttaactattttttgtctgatcattggctatttttatttttttaatttttgaattacgtgtttattttatgcaccattttcccatatgtaactttgtttaaagtttttaagttaaagttattaataattgttatgtttcatcatattaaaatttacaaaaatgacacagtcactataaaacttcaaagacataaagcatttaaaataacatggaaagttctcatacaactctgttcactcccctcaaaatattctcaaagtcccctgccattaaagtggtgtgtattttcaatgcctagaagcatacatatgggtgaataccaaatataattcagaaatatgttaaagatgggttcaactattaaaataattttcaagttatagtaatttaaaagatatagcaatcacacaataaaaagagacaaatagaaaaaataaactctagaaatatattcaaacacattgaaatttagcgtataatataaatggcatttcaaatcagtagggaaacaggatcaatttcatagatggtatcaagtaattggctattgtttgcttcttactccaaatcataatgtagctatgctttgcttcttactccaaaataaaatgaatataaggatatgtgggaaggtaaaaatgtatctataaaataactaaattgctgaggtagggaatgcctgtcaagaagctgtataaatttccaaaattaatagacacaagactgaatttgtgtctggaaaatggcagataggatgtagaactaacttgcagctcccacttggatggacagagctgcatgtggagacctatatcatgaaattttgttccaagaactactgggggaacataccaggaaagtcgagagaatccgcagaccctttgaaggaggtggattgccgctgcaggctttatgctacagcagaggaactgtgagtctgcttgccttctcagctgagaggcttgaagcctggggcaaattctcaaccctgctcactggctgcctggaaataaacacagtgctgttgtggggacaaggtgggaatgagactggccattcaggctgtgggctgcatgggagtggagtgaggactgtgacagccggcttccttccccttccctagtgacctaggtaaagcaggagatacagccataattctcctgggaacataactccactggcctgggaactacacccctatcccctgcagcagccatagcaagccctgcccaagcagagtgtgagctcagacaccctaaccctgcccccacctgatggtccttacccactctggtagccaaagacaaaggacataatctcttgggaaatatatgaccccacctaaagtctgatcctccctatacaactgcagctaacaggctcttgaaagtgccatctcctggctggagaccaaccaacacaagattagcacacttaacaaaaacaaccaaggacccttatatagtccatctcattcccctgctacctccaccagagcaggtgctagtatccacagctgagagacctgaagacagatcacatcacaggactctttgcagacactccccagtaccagcccagagcctggtagctctgctgggtagctagaaccagatttggctctcaggaagctttatccctaggggaagggggaaagcaccacatcaagggagcatgctgtgggacaaaagaatctgaacagcagcccttgagtcccagatcttctctttgacatagtctacccaaatgagaaggaaaaacagcaacaacaacaaattctggtaatatgacaaaacatcttaaacactcccaaaagatcacactagctcaccagcaatagatccaaaccaagatgaaatctctgaattgccagaaaaaacaaatcagaaggtggattattaagctaatcaaggaggcacaagagacagatgaagtccaacttaaataaataaataaaaaaaaatgatacaggatatgaaaggaaaaaatcttcagtgaaatagcaaaaataaaaaataatgacgaattctggtaatcaaggacacacttagagaaacagaaaatgcactggaaagtctcagcaatagaatcaaataggtagaagaggtagaagaaagaacttcagagctcaaagacaaggcatttgaattaacctaatctgacaaagacaaaaaatatataaaaaaatgaacaaagcctccaagaaatttgggattatgttaaaaggccaaatctaacagtaattagtgttcccaaaaaagaagagaaatctagaagtttggaatatttgaggaaataatcaagaaaaacttccctggccttgctagagatctagacattcaaatgcaagaagctcaaagaacacctgggaaattcatcacaaaaagatcattgcctaggcacatagtaatcaggttatctaaagtcaagacaaaggagagaatcttaagagttgttgggcaaaagtatcaggtaacctataaaggaaaacctatcagattaacagcggatttctcagcaaaaaccctacaagctagaagggattggggtcctatctttagcctccttaaacaatacaattatcagcaaataattttatatccagtgaaactaagattcataaatgaagaatagtcttttttgaacaaacaaatcctgagagaattcaccactaccaaaccagcgatataagaactgctaaaaggatctctaaatcttgaaacaaatccccaaaatataccaaaataggatttccataaagcatgtatctcacaggacctataaaacaataacacaatgcaaaaaaagcaagatattcaggcaacaaatagcatgatgaatagaatggtacctcacatctcaatactaacattgaatgtaaatgatctaaatgctccacttaaaagatacagaatggcagaatgaataagaattcaccaaccaagtatctgccatcttcaagagactcacctgacacataaggactcaaataaacttaagataaaggggtggaaaagaatattccatgcaaatggacaccaaaagtgagcaggagtagctattcttatatcagacaaaacaaattttaaagcaattgcagttaaagacaaagagggacattatattatgataaaaggactagtccaacagaaaaatatcactatcctaaatatatatgcacctaacactggagttctcaaatttataaaactattaccactagacctaagaaatgagatagacagcaacacaatactggggacttcaatcctccactgacagcactagacaggtcatcaagacagaaaattaacaaagaaacaatggacttaagcttcaccctagaacaaacagacttaacagatatttacaaaacattctacccaacaactacagaatatgcattctactcatcagccatggaacaaagagtgggaaaaaaaatcttcacaatctatacatccaactgaaggactattatccagaatctacaaggaactcaggcaaatcagccacaataaaacaaacaatcttatcaaaagtgggctaaggacatgaatagtcaattctcaaaagaagacatacaaatggccaagaaatatatgaaaaaatgctcaacaccactaattaccagggaaatgcaaatcaagaccacaatgtgataccacttcacccctgcaagaatggccataatcagaaaatcaaaaaataatagatgttggtgagaatgtgttgaaaagggaacattttttacactgttcgtgggaatgtaaactagtacaaccactatggaaaacagtgtggtgattcctacaagaactaaatgtagatctatcatttgatccagcattctcactacttgtaggaaacgaagccattatatgaaaaaagatacttgcacacatatatttatggcagcacaattcgcaattgcaaaaatattgaacctgtccaaatgtccatcattcaatgagtggttaaataaaatgtagtacatatatatatgtatataacatggaatgttcctcagccataaaaaggaatggaataacggcatttgcagcaacctggatggaattggagaccattattctaagtgaagtaactcaggaatggaaaactaaacatcattatgtactcacccataagtgggaactgagctatgaggatgcaaagacataagaataatacaatggaggccaggcgcagtggctcatgcctgtaattccagcactttgggaggctaaggcaggtggatcatgaggtcaggagatcaagacaatcctggctaacacggtgaaaccccatctctactaaaaatgcaaaaaattagctgagggtgatggcgggcacctgtagtcccagctactcaggaggctgaggaaggagaatagctgaacccaggaggcggagcttgcagtgagccgagatcgcaccactgcactccagcctgggcaacagagcaagactccgtctcaaaataataataatactacaatggactttggggccttgggggtaagggtgggaggtgggtgagggataaaagactatacattgggtacagtgtacactgctagagtgctgggtacaccaaaatctcaaaaatcaccactaaagaatgtattcctgtaaccaaacaacacttattccccaaaaacctattgaaataagaagaaagaagaaagacaaaaaatggacacaagactggaaaattttactgcataaaaacataaacatctttaaagcataacctgtaagtccagatccccacaacaaacgatgagagggagaataaaaaagaacattagtttcactttgtagtgaaataaactaaaaagctcaagtttcagagtacagtgctccatatttttggcagctgcctcctttcttcttgtgtggtctaaatgagactgtgctgactaaagagcatgccccatcatattcacagagccagcagaggaccctccctttcatgatcaaagctaattggataaataaatatacacaatttcaaaaaactccataatctgttaattattctagctcatcatttataaacatgaatagatacattagtactaccaaaccaaggaaacacaaaattatgagtgataaagatggaaaactaaatgactgacccagaagtaaacggtttttgttttcataaatattactttaaaagttatttgttttattcagagataaacaattcagagaatattgcactgagaaataataggatcctatgttcaatattatgagcaataatgttgtaattgcaataagtgaacaatctaaaaatattaattgagtatatggaaaaaaacagcattggtaagataaaaataaatccagagtaaactaagataatttaggcatataaataacacctattcttatagtgaaatctttgataacatcagaagccaggctcctttgccatccccttttattggttcctatacagattacccctaaactcccttaaaagtaaaaataaaatgaaggatatagctcagaaaatggagcaaaaatataaaaagaaggttagtttgactaataacttatctgagaggacagatgtaatagctctggaatttgtttcagaggaatatcaggagaagataaagaaatgaaaatattttaaaaatatgattaaaaataatttcccccaaatttaaaagtagccctgctgggcacagtggttcacacctgtaatccaggaatttggagactgagatgggaggatcacttgaggccacgagttcgagacccatctgagtaacacagtgagactgtctctaaaaacaaaaaacaggctgggcacggtggctcaagcctgtaatcccagcactttgggaggccgaggtgggcggatcacgaggtcaggagatcaagaccatcctggctaacacagtgaaaccccgtctctactaaaaaatagaaaaaattagctgggcatggtggcgggcgcctgtagttccagctactcgggaggccgaggcagaagaatggcataaacccgggaggcagagcttgcagtgagctgagatctcgccactgcacttcagcctgggcaacagagcgagactccgtctcaaaaaaacaaacaaaaaaaacccctgagtttcaagagaaaataataaacagactctacacacattaaaatagaaatgatgcagactgcaagttcttataacaaaaattttaataaatcaaaagtttcaaaaatctttagtttttttttaatgactaaaacccagctaccaacaatagagaaaaaactcctaatactgtacttcttagtgacaagagtacaaatgcagagctcagtggagcaataatcttaaatttatgggtagacataatctgaaactagattcctatacccagctatattcttatccagatataaaggcaaattaatgaaacttttaatatgccaagactcagacaatttgtcacccacaaaatataggaaaaaatcacttaagaatgtacttcagagaaaataaaatgcattcaaggcatacagttattatctgtacttttcaggttatttatgttttctttatctacatgttggaaatactgtataatggtgtgctgctgcacatcacttcttatctccacattcagcgatgccatttgggtagcttgaaatcagccaatgcttcaaatcaggacttgattcaatattttgttgtttgcctagagttaggaaagtaatagagaaagagttaatagcatagattaatgtgtgcatgtctagtgctgaagatgaaataggtctcattgtaatgagtataatttgtataagggtgataaatagtttaagaggagatcacaattcagatttaatgacaataactgtattgcaaaaagtaatagatgagtaggataaaactccatttgttgaatcatgtttggattacaaccagagtttgtctacagataacagaatttggcaaaaaaatccatgaaagcattgtatacaaattcgtaggttagatataatttacaataaagaatattatgtattttattatcatttgtatatcaccaaaacttgtaaaaacttatgtaagtatatcaacatatacatttttcccaaagagccagctgttaaatatttactagtatgccactggttatgaatgattttatttcactttttatagctctctatgtgtctgaattaaatatatcttttgcttttataatcaagaaaaagcatattatttaaaaaccactatagactggcatactgcccagctttagtttggggcattaagtttttcctgttgaggcagaacgagcaccagagtgccacaatgttaaagttgttttatgagctctcaagttcagaaagagaagcaatgttatatgagccttaaataaaatgcaccaggccagggtcattttatatataatcctgtttaatacccatcataaaccaaaaaagtaggcatttttgaaattttaaagataggcggacagtgaagccagaggtttgccagaaaggtctagattttataaaatggagtgaagtgatatttacctgatcctttacctaacctcagctgggcagatccagaaatgctgatatttacctgatcctttacctaacctcagctgagctgagcagatccagaaatgctattttgccagtacactgaaattgagtgattcaaggagattcaaccttaagatagtgaactgtataaatcaagattctagggtattacattaaaataagaaatgtcctgtcaccaggctcagtgttcatgaaggcctgactagcctgacctctctctataggaagctacctcagtcatcagacagatgcttggaaagcctgaaatgagagcaacagtagtgaattacaggattttaatgtttaatagctttatgcccaaatattctaacacatctatacccataatggggataaatcttccctaagacagaatgtttaattgatgtggatggagtttgcaaggccttggtaatgttgctttttcatgacttccattgtgaccatgtaatgattgatcttttctttccttagttatattgaaactctcaatcttgctaccttgggcatctaagagctattgtgttgatttataatttatctctcaaaaagcaacctgaatacacttagtcctttatgtgagaggtatgctattttcccctaataagctaaagatataaatttcttcatttacccaggtcatccttagtgtctcagagagagtaagcagagagagtgggcaaaggtgatgtatctatgcctgtgcctgtgtgtttgtagtgactctgttgggaaccaggggttaaggggatctggaaggaatggtgaggagcttattatacagactgcttgtaaatctagtgttgtagtcttagatgctgcttctataattctttttgttcacctttgttcagaatttagatttcttgttttcttagcctattcttgattaataaaattaatgatgtggattattttactctgctcagagtatttcttggggtttgggttgtcttttagctactcaagccagtttctatactggttctggaaatttctaaaaagttaccaattcacttgatggcagtgaatgtgaacaccctgaggtccagagaagacctaattaatgcctttatgtatttttgtcatattttaaattattcatatggccacattttatgatctattactatagatcatatatatttatacacacacatacatacacattgtattaatcagttctcatgctgctatgaagaaatacctgagactgggtaatttatcaagaaaagaggtttaattgactcacagttccacatggctagagaggtctcaggaaacttataatcatggcagaagtcactacttcacagggtggcagaagagagaatgagtgcaagcagggaaaattccagacgtttataaaaccatcagatctcatgagaactcataactatcaccagaacagcatgggggagactgtctccatgatccaatcacttcacaccaggtcacttccatgacacgtggggattaaggtgactacaattcaagatgagattttggtggggacacagagccaaactacattattctgtacctggcccctcccaaatctcatgtcctcacatttcaaaacacaataatgcctttccagcagttccccaaattcttagctcattcaagcattaacccaaaagctcaactattaagtctcatctgagacaagacaagtcccttctgcctatgagtctgtaaaatcaaaagcaagttagttactttctagatacaatgggggtacaggcattggataaatacagacatttcctatgggagagattggctaaaacaaaggggttacaggccccatgcaagtctgaattccaatagggcagtcattaaaccttaaggttccaaaatgatctcctctgactccatgtcttacatccaggttatgctgatgcaagaggtagactcccatggccttgggcagcattgcccctctgacttcgcagggtgcagcccctctcccagctatgttcatggctggcattgagtgtctgtggcttttccaggcatgcagtgcaagctgtcaatgagtctaccattctggggtttgaaggacagcggccctcttctcacagttccactaggcagtgcctcagttggaaatccatatgtgggctccaaccccacacttcccttctgcactgccctggcagaggttcctcatgagggctccacccctgctgcagacttctgtctggatacccaggtgtttccatacatcctttaaaatttaggcggaggttcccaaacctcaattcttgtcttttgcacacctgcaggcccaacactacatggaggttgtcaaggcttggggcttgtaccctctgaagcaatgacctgagctgtaccttggccacttttagccaaggctggagtggctgggatgcagggcaccaagttctgaggctgaacacagcatgggggcctggacccagctcaggaaaccatttctccctcctaggtctccaggcctgtaacagaagaggctgccataaaggtctctgacattccctggagacattgtcttggtgattacaatttggcttctcattacttatgcaaatttctgcagctggcttgagtttctcctcagaaaatgggtttttcttttccactgcattattaagctgcaaattttccaaactcttatgctctgtcaccttttgaatgctttgcagcttagaaatttcttctgccaggctgagcgcggtggctcatgcctgtaatcccagaactttgggaggccaaagcaggtggatcacgaggtcaggagattgagaccatcctggctaatatggtgaaaccccgtctctactaaatatacaaaaaattagctggcagtagtggtgggtgcctgtattcccagctactcgggaggctgaggcaggagaatggcatgaacccagggggtggagcttgcagtgagctgagatcatgccactgcactccagcttgggtgacagagtaagactctgtctcaaaaaaaaacaaaaaacaaaaaataaaacgaaatttcttctgccaaataccctaaatcatctctctcaagttcaaagtttcacaaatctccagggcaggggcaaaaagccacatgtctctttgctaaagcatagcaagagtggcctttactccaattcccaacaaatttttcatctccttctgagaccacctcagcctggacttcattgtacatatcactctcagcattttggtcaaagtcattcaataagtctctaggaagtttcaaacattcccacatcttcctgtcttctgagccctccaagtctctaggaagttccaaactttcccacattttcctgccttcttctgagccctccaaactattcgaacctctgcctgttacccagctccaaagttacttccacatttttgggtatgcttaaagcagtacaccacttctccatactaatttattgtattaatccattctcacactgctatgaagaaatacctgagactgagtaatttataaagaaaggaagtttaattgactcacgtttccatatgactggggagacctcaggaaacttacaatcatggcagaaggtacctcttaacagggtggcaggagagaataagtgcaaacaggggaagttacagatgtttataaaaccactagatctcatgacaactcactctctatcaccagaacagcagaggggaactgcccccatgatccaatcacttcccatcgggtccctctcacaacacatggggattatgggaaacacaattcaagatgagatttgggtggggatacagccaaaccatatcacatatactgacaggaatggcaatttaaaaaattattcaagattgtctttctagagattagtcttctagaaaagtgagaggctaacagagtatttataaatatttataaatgaattacatatactatatataacattgtcccaggtctatcaacttataatggacttttcaattgctgaagtgaagaaaatgtaactttagcttgttacaacagtgattatgattaatgaccttttcagaagtcataaggagcctctccttcctctatactccaccactgccaaaaacacaaattgttatttatatttcattaccccatcacatagggtatttagccttagtatacaagattaaggaattattacagtaagaacagttgcctctatagtattgcccagaaacctcactgaatcagaagttggactttaaggctaccagcatggggtcagctgggatccatggtaagagcctccaaaatgactccttcaatagaatagcagaatggcagataaagttagaattgccaaacctgtttaaaaatgaagattatttgatggtctcctgggctatcctaatcaacttgaagccgaaagtggcattggaggatgatcactgagaggttaaatacttaggcatatgtacattttcttgcaataatacctcctttaatacattctagacagcatcttggtaatgagaaccatccaatggaccatccagtcaatttctggtagggatctaaaccaatgtaaaaatgatatatctaaaaggcaaattggaaatatgggtaaagaatctatcatacatatacattgttaaagttcttttcaacctctaaaaaggtccctctctttccaacccattcaaacatttaagatatatattttttaatactaacaacatatcttctccttggtaaggaaatcaatgtcaaaattcctatctctacactgtctctatcacctctttcttattgctgccttactgaagacagctgggaaaaaatataaaataaagaacaaggccaaatagtaatgcttatttttacctaattttctaccctattacacattcagacattttccctgtagttgcacccagctttttgcagatgcctcagctattagaagtattcctttcatttatgatcaaaatataaaatccttaatgtaaaatattaagatatagcattatgaaaatatgcatataggaaatactttaaatcctatgcatttacttctttgagttgaatggtgtcatggctaagacaacttgaatgagatttgacctgagttttctctgaggttttcctgcagctctgcctcagtgaacagattgcagatcactctgtaatagacaccttcgtccaaaactccctgcctgtgttcggcctgccagaattgctaataagtttaaatatagtaggtaaccacttttctgtctatttatgtcactttcatttcatcataatttagtatacacattttaaaaatgttatatagtccttatattttaatttgaggtactattgctttcgttctcatattttttttatcactgcacactaatgttgttaaacgtcttcatgttccttaagcatccatttttcaaaactttaaatgaattttaaagtgccagggcagacaaaatgaactgagacacttttactaagttacatccctcaatctgattttcaggaaaaaagaaaaaaaaacccaagacacaagactaataaagatatatctctatgtgctgaatcttattttctacatgttatcttggctagatgaactgccaaaaactaaatctgtttttatataaattgtctacctgagtcttcaataatgttacccaaagatgtagcaacctaataaaatagaataaatatttcattaaaattgtgtagaccagaattcattcaccacaagtagtgtttatgtgattattacctcctctcaaaaagaagcattacagagatatggtaagaactcatagcttctgtcctacaggaattgccagcctactgagggagtgggtagcactcagacaattgttcaggccccaagaatccagagcactaagtgtcatggtagctgcagtgcagcaggaatagagcacagggagagggaacgaatccagtgtgaacagcaaagttttcctagaaacagttatttctaagtttacagcagagcacaatgatattaaattagtgacatgtaaagttggttatatatttccctatcaggagaataacatatacaaaagtcaggaggcaagaaaatgaattctgggaactgaagaagagctgataaaaaaggattgggcccatttaagattttttaggtggaagaaatgagacatagtgattaattgtatatgaggggtgtggtaaaggaaaacatttaaaatggtattaggatttctagctttagacaaggtaagtgttgactgattcagagatttatttcaaaggagaaggagtttaaggacataaaatataaaaaggaagatattttgggggtgagtgggattggatttgaggagtctggggacacctgagtagaggtgtccagtggtcagtagacacgtgggtttaaagcttagtgacagagttgggatgaagctggaaattcaaatccagagtggaagtatagttatagtattaaaagccatggcagtgaaaagaatatcttcagatatctaaaagtcacaaattaatgctaattgtcaccatacctaagaatttgagaaaaagaaagataaggtagagtttaaaaattaagagaataggccgggtgcagtggctcatgcctgtaatcctaatactttgggaggccgaggcaggcagatcacttgaggtcaggagttcaagactagcctggccaacatggtgaaaccccgtctctgctaaaaatacaaaaattagccgggcatggtggctggtgcctgtaatcccaactactctggaggctgaggcaggagaaatgctggaacctgggaggcagaggttgcagtgagccaagatcacaccactgcactccaggctgggcaacagagcaagactccgtctcaaaaaagaaaaaaaaaagattaagagaatagcatcagaaaggaaatatgcaagaggcattctgaaagatagttagaagaatagggaaaaaaatatgaaaacccagtcctggttatccttctaattagctatgtaactctaagcgagtctcttaactgcttgatctcagttgtttctttgaaataacagagatgtctacatgttaaatgttgttaattatacagcactttttgaaagtagtgcatgttaattctgttcccaataaattcatattttgaagtcctaacccctagtacctcagaatgtaattgtatttgggtctttaaataagttattaatttaaaatgagggctttagtgtgatctttatcccaatatggctggtgtcctttaagaagaggaaatttggacacacagaaagagagaccacacacgtgcatatacagagaaatgactgtgtgaaaacagagggataagacaaccatctacaaggtaaggagaggggccgcaaaataaaaccaaccctactgacaactcgatgttgaagtttgagaaaatagatttctgttgtttgaaccacccagtctgtagtactcattgtggcatacttagcaaactaatacagattttggtaccaagtgtggggtgcttctgtaacaaatacctaaaaatgtggaagtggctttggaactgggtaatgggtagaggctggaagagttttcgaggtacatgttagaaaaaaatctaagttgccttgaagtgatctgttcagggtctagactttttttttttctttttacaaataatcagagagtgtctctctagcctctagaggctagagaactctagaaactctagagttttcattccttgaaaatgagtttatttctccttagatgatgcaacataattttgtttttagactgtgtccaggcaatccaactccattttaaagtggataatgctgcaaggttaagtctagtagaaagtattttggctttttttttctactagaagtataaatgacaacattgaaattttaaaataaaagcaaaaaaaaactattaataaaactgtagatttaagatggcagaatattttagatgttgaaatatttaactatcatgtagatatagctacagaaaaaattaacagtgaactgtttattcctgccaacaagaagaaaacttttcagaagttactatttttctgtgtaaaaactgtggcaatagaatccactgtaaaatttatcttatcaaatttttgacaaatccaagatttgttctatgattattaatttaactaaacatatgtaatgagaaacaaatatgtgagttgacattaccacaatgatagaggaaaacagttgtggatgaatgaatgttaaaattacatgaataaacctttagggcacacacagatttgataaaaggagagtaagatccagcaatgagattaggaacatgtgtttagagagatagaaacagactgtactagatgttaagggaagagttttattcagaaggatatgtgaaaaatgttccagagagagcaatgagcttgactgacagaagtttaccctagtaagccttacacatcaacttgatctatcccttttcaatctcctctttctcaatgcaaaaaaaggaaattcttcgaaaaatagttatggaaaaataatgtcatttcacttaatttgagatcattttcatttatatatttcctagattctatatttcatctatttctttatcctataaagtctggtgaataacagcattaacctccctccactgaaagaagaattttcaaggccaatgctcccctttgatgatttcctcttataacttccagtagcattccgtttcttttctggacttctactgtcttcctgtcttcagtctttaaatccccttaaatctttcccatcttaaaaaaaagaaaggaatgaaaaaaaatttttaaacccaaccttttttgaccttgcatcttattctaaatactgcagaatataaagtttagattttacatggaaatccagtagtgtaatgaagaggattgaagctgaagtcatattgctttggtttttacttccagtttcagcacttggacaagttacttaatatttcaatgcctgagttttctcactgtaacaatttcacagatattcccatctcttatggttgttataggtattaaatgcataaatatacatgaaatgcttagaacaacccctagtaataactcaatttgtgttagctattattattcttatcatcattacctttctgtgttgtttttgccatgctaaggagtctgaatgtagtatcatctctccaccccactttctgaagacaatgaaggttaaacccttgcagatcacacaaaagggggaaagtcttcaattgatttgctgggtttaatggattattagattcatatgtaaaaatacttgtagattaaagttggaaaggtatgacatagaaataagaataacattggaaagaagataaaggtaggaaaaaacttgtatttaatctagggtgagcaatcatctcagtttgttcatgtgtgtccttgttttaacactgaaaatcccacattccaggaaatttctcagtgttgatcaaattaagatttgaccttaattaccttaatttcagccaatttgtaaagattgccagaagtcaaaaacagtagtgtttgccctgggtgagttcatggtgtttcttctgactaggtgtgctccttactcctgatgaccaatttttcgaaatcaaggttcaaagcctcaagatttagccaatattattttcctcttaaattactttctctgatttatctaggcagaatgatgtgattcctcctgtgtatgcttctacagtaccaaatttgtatcttttgcatggaatgcacacatgcgcgcacacacacacacacacacacacacacacaccaccttgaattagatatttgtgcaatgtctgatctccataattagcttgtaaggaacgtttaaacagaaaccatgtgccatgctgttatctcacctgcagcatcccatattgtgcctgttgcttaaaggatgcatttctatttgtgtgacaaatgaacaaatggacataaatttaggtatgccaaaaatccctgcaatggaggatggactttttaagaagaaacaaaagctgtcatatttttggaagccacaccatcttctcaattcactaaaggattcatcgtttgatttcagccattatcttcgaatagtatacactaaaataaatccaagtgacaccggagagaaattccaggatgctgtttataagaccacaaatgtaatgaatattttttgtacaagtggcaattttctctatctctgtcatgagaatgaagatgaatttgtttctctgttctggcagatttatatgtaaagaatacaaatataggaagtaatatgtcatttttaattaaatgggttaataagtcaggagtgaacaaaataaaccaggaaactgggacctgtgaattttcagaatgcttggcactttgtccacaggaagattcattttaaataaatggtacaccctcaaaatgaacttgtatcattgataaatatttgagtccgtataatgttatgtcaattggccatacattaaaacaattaccctaaattaatactgatcactgccatttaatattcactagttatttatcaaacctctttgtcctttctcccagaggaaaaaataatgagagataagctttgctactcagtcctcctagtaggattagaatatgccaacagccaatttttcaggcaagttttaaaatgtcagcagtattaagaacttttcctaaaaccttacatggtaatataatattttaaagcctgtcctaatccctggctagaaattaattctaaaaatatatgttattttcttgtatttagggcaaaatagttatatgtgaatcatgctttttacccattaagacatttctacaagatggtaagccatgtttagtgaaattcgttgaactttatcagtccactgaaatctgaaaatttggaagactctattcatcattgtcacctgagctattaatgtaggttgatagtatcaaagctttatttcttagttgaatgaaaaatacttttgcttctgaatgtaatagcttcacaaataattagtaacacagaaaagaacttaagttactcataaatatgatgagcatataacctatcatctaaaccttacttataaataacctattcaagagaatttaatacataaaatgcattttaatagaagataaatattttgaagtagaaggttttgtaaaatattttgtacttttcccctgcatcgtgagtacacctacaagtgagaaggtagtttatttcagatttatgttgctgcaagtgaatgaaaaaagtggcaaactctttctcatccccaaaagatagttattttgacttaggaagtttggaagcaaaacaaaatatttgcactacttccagaagagaacttctacgagacatttgttttagaaaatacatccaggttgtgagaagacaagaggaaaggccattcacattgattgatttgaaagaagtatggaggatcaggggtgagcactgatgaaactgtctacctgtagcagcagtacatgcaccatgaagtcttagatgacaggccctctgaattgatggcaggagaattgggcattgggtggacaaatagaggggagaaagcagaccagaatactaaaagcattgagagccacagcaaagcattcctgtataagaacaaaagaataggcataggaacaaaagaaacacttcagaaaagccatgttggcttgggcaagcagtgttcaatatgaactcaagaccaaatattccagcttacctaaaactcagtagaagagaagactccgtaaaatatgatcttaactgaatttactagtagtcaaatgagcgtggcatggactaaatgttgtgatttagagataatataaggagtttaagaaatgctatacacccctcacataaatgagaggagatgtttgtaaagcatctggtttgctttgatcatccacatttattagattgatgtgcgcataccttattcagtttgaaattttctactttagtggtaaaatcaatttcagtatctaaaagtcacaaattaatgctaattgtcaccatacctgagtgatcaaatcctaaactatcatttttccctgtcctcagagaacaatctactgaccttggtttaaatcatttggccttggaagacattatgataccctaggatttggaatcttgatagcacaactagcatactacaagcaaaatcacagctgttgtatttgcttctgatgccaggggttacttatcttcaagtattggagagcaaatgaaacagatggtccaatatatctccaactgaaacttttataagcaactgctaaattttgcttatggacatctgaaacaagagagctgagctgaagttgaaaaacagttttatttcattctcagcatttaaacagaaaccaaactgttttacatgaaaacctttgaaagatttagactatgcttatgtaaccctctgacaactaccaggtacaattgtccttgtttaagaatattatgacatattaccataaccaaatcagtgaaaattaaaaccatgcccatttcctgtagctaaaatagaccctgaaatgtcatacttcaccactgttattgctgacctttttatagatgatatggtttggctttgtgtctccaccaaaatctcatcttgtagctcccataattcctacttgttgtgggagggacctggttggagatgatggaatcatgacgtgggtctttcccgtgctgttctcgtgatagtgaatgggtctcacgagatctgacggttttaaaaataggagttcccctacacagtctctcttggccagcctcccttccactcacgtggaactgtgagttctctgttaaacctttttcctttgttaatggcccagtctcagctatgtctttatcagcagcatgaaaacagactaatacaatatagttttgtgactacaagtatgcagtctatttgaggtctgagtgtctttcaggagcagcttctgcctggagtctacagtacacctcagtaacattgttgtgtcatacagtcctcaaatacttaaaacactggattctttgaaaagaatattatgaaaacaacaccctaaagtgttaccaaaagaggaggaggtctttcagttagaatcatcatttgtttaccaattaattgcaacagatattttttgagtcccctgcggtatgtcagtcactggaatacaaacttctttgtgtgtgtttatgtgtgtgtgcatgtgttgtgtgtgatttttgtaacttttaatggtggttatgttttgttccaatatgtgccaatacttagtctatcagttcttaacagtttatattaaaatacagttattattatacaaataaagtactaaattggactaagtaggaatcttgacaacataaaagataaaataaaacatattatggacatattaatatctctatacttagttttttcatgatgattctggtagatatctgttgtttctgtctgcttctttttgtttatcattctaccttaagtacctgtatagcatttcatcttaaaatgaagtaaagcaaaaagaatatataacagatgtatttcctggcttgttttgaatctttggagtcttaatgctaagtacataaatcttatttttctaagttttagcaacagatattaatttttgtgtaaatttttggttgtagcaggaaaaaatagattttgaaagtctgatcagcataacaaagggtaacccttctttgaaattatttctccacaatatgtgctatgacacattaataaaatagttgaaactgaagtcagaaaccaaaataatagagtggattttgttacttgtctcagaaaaataacctaaagaagtgagttgttttggctcaaacaaaatagaatacaatgactgtcatccagagactttaaatattattattttgataggaattaagggtgtttatttgaataaattgagctagtttctttcttgagtttctcctctctcacctcttgatattgcagacatttaaaaaatgcaatggagcaatctgtaaacgaatgtaacaataaacaaatgccagaatattaatgggctatcaaacaacagaagcagtgattctggaataaaagcattttttttgtctaagatgaaaagttactacagggaactctcttgatctattgttttatactgttaaagaaagtacattaatgaaatgtgtcagggtaagatggcagtctcagcacatcaaatgatgcaggcaagaatatagcaaagtaatatctatcagcaggtcaataacttagaaaagcttgaaatgattgagaaatgtgcatggaagaaggtagtattctatagctattcaaggcaatgtatcaaagaagtgtaaaaatatacattagaatgggtcagttattcttagatcagaaggaatgggataaagaaatgatctgagaacagaatataggaattatgtggcttggaagtagagagagaaaagacatgaacatttatcaatgacaaaatgatcacaatacctttgaggtactggatttgagggaaaagattcttccaaataagtgatcactctgattaggactgaacaaaatgactgatttcactgctcagtcctcagactgccaacctttctacacccctgctctgagcgtgtgtgtgtgtgtgtgtgtgtgtgtgtgtgtagtatcatagaagtctgtcccctttaagttgctggttggatcaagtgtgggtgtataatagaggcaaaagcaatttatagccaggccagtagcctttagatattctggtgtcacagccctgtcaaacagcaacagtaggaacaaaatgaaaaaaaaaatgcagaaaacaaaagacatttgacagaagggtataaagatggactcaatttggtaatgggacataagattaataggaagaagacatatagaaagaagccaaatggtagaggctatgactaagcaaaaggcataggaaaggaaaagtcacaaggtagagagggaattatagagaaattctaatatttgggagtgcaggaatagtacaatcgagacagccagggaggctgcctttattgaggtatccacttactggacttcctgtaaagtcaataatgcatccttcaggctacttgaacactatgtgtcttctctttgagccctaacaccattgtttctaattcccttactttctcttgcatcttttaaaataatctgtatcatccacagtaacctttgccacctgacaaagcctaacaaatgtggaaaatgtggtcacgttctgtaatagaggaaactttatgaaagaaaatgagtctgtttatgataaagaaagggataagaaaagaaataatttatcttaaataaccaattgttacataaggataatgatagtagacttgaaatcattaagggcgatttttattttgctggtcggtagtactagtgattataataatgataataaaaataaagatttttatatattggtgacttacaatcttctgaaaattgtgctgccttctaattgagcttgtctttcattttcaagcactcaaaattttaggaggtaaaagttcattataatttccatatgagttataggttggtaacttctcaaattcagagaggaagtggcttttgtgagaattgaacttgcctatatcatacaatacatgttgctttataccttatttgatctacatgtgaacatgcttctctaattagtggtaatcctgacagattaaatacaaagactagattcagattgttacaaacctgagggtatggtacattctcaacgactttgcattgatgatccctgcattaatatgtgcttttaaaatgataggaatgtttagaaaaaataaaaaagtttttgcaaaggtcattttttccattaaatgtgttataattgacatgttcattttatagttattcagttcttagggtttaaaaactaataaaggtgacatgatatatatataaactctaatcatctacatcaaattaaatgttccatgagttttctaattatttttgtagatttgagcatataaggcacacaaattattgggtaaattaatccatagcccatatgtttgtttatcaagatgtaaggagtaacaagcaattataaggaattaaggatgctacgtaaaatgaaaaattcataagtgttattatgatattattatggattccagatttttaaggtcatttttttttggagacataggcttgccctgttgcccaggatggagggcagcagtgcagtcttggttcattgaagacttgaactcccaggcttaagcaatcctcccacctcagcctcctgagtagcttggactgccagtgtacatcaccgcgcctggctaatttttaaatttttatagagagtatgttgcctagacttgtcttcaactcctgggctcaagctatcctgctgtctcagcctcccaaagtgcagggattacaggcatgagctaccatgtctagcctatatttaagatcttttaaaactcttgctgagggagggatataagagctcaaatacaaattaatgacagccttctgtttctggtagtacagtggactaagcacactaaacaaacctcataataaagataaaactgaaagattggacataaataaaaaggaatatatagttttatttttatatttatttcatattatatatacatatatatgtgtgtgtgtatatatatatatatgatacatgattgaaatggcaggaagataaacagttcacagaggtcaaacaaaaattacgcatgtaggtcaggcatggtggctcatgcttgtaatcccagcactttgggaggtcgaggggggcagatcccttgaggtcaggagtttgaaaccagccttgccaacatgctgaaactccatctctactaaaaatacaaaaattagcttgcagtggtggcgcatgcccacagtggtggcacatgcccacagtcccagctacttgggaggctgaggtgggagaatcacttgaacctgggaggcggaggtggcagcaagatggtgccatttgagacggagccactgcacaccaggctgggtgacagagtgagactctgtccaaaaaaataaagaatgaaagaaaagaaaaaaagaaagaaagaaatagaaacccgggggaagtaagcaagtcaatttaatattcataccaataataatatattatacaattttttaaaagatagctttgaacatattaacaaaaagtgttaatcttaagaagaaaccgagcaaaaggtatacaatctgtcaaaaattttgataaaaatatatttaggaagttctaaataaatggaaaatatttgttagtagtgaaaaaatacaaattatgtgaattcttcttaaattaatatatagattcaatgcaatcatcaaaaatttacagggtttctcatttattctaagaagtagtttctaaaatatatataaaatagcaaaattttaagagtagccaacactcttgaaaaggaagaacagaaaagattttctattagacaaatggacatatttaaataggaaaaaaatgtataggaatgtccatatcagcattatttttaatagcaaagaatattaattgatatctacttatccatatcccagttcccagtggggcatattgactaatgcctacatctgaagatgttcagctcttgtcatgctctaatggattcctgctaatcaagtatcagttttattgtgttggaaaataagtcttctaaattagtatattaaccttttgtgtatgtgtgtgttcattcttttatttacattgttttatgcttttcttgatgtaatcacctctgtggatgaagctacttatttctcttatgtacctacagcagatttctgtcgtatgaaatctttactattttgtcaccaagtatttggggttgtttagaaaggagatgttgtgtattgtgtgtagcccttgctgtgttacaaaaagctaactgtgctgcctcaagttcctctttatttatggattaaatgtgagacagaggttaccagtgttatggaatcttacatagatacaatccagattttctgggaccaacacactgaatgagagcataaagtaaaggtgtggcaagatgcaaacctgagtataatttttagaaacctgtggttagtattagagtgtattttcacttcggcatcatcgtgaggactttgataccttgaacaacagagccaggtaactctggagtggacacatgagcaaacatggaaaataaacctaggaagttatcagtccagtggagtatatagaaagcttgtttagataaacatacctctcaactgatgataaataatctttggagaaagaaacaggaaatcagaaaaactacatggttttttgatggcctctataataaaaatgtaaagttttaagcaatggagcaaacaacttacaaggtgtttaaatggcaggtttaaatgtcatatttgaactttactcttcttagcctgagtgcttgtacagacaatggaaacaaaaatattgcttcttatctcttggtagctatgggaaaataactttaaaattcagaaatagtgtcacacaactgtattgggaaatttcaggaagaacagtatttacaaatttggcccagagtagaaaaaagtcaaaattaactgatcatactgtcaaaaatatgtatattaaggaaaaaaatttgactgagttaagtgatgtcaccctgtagacagttgttaactatggatagtaagtaatgctaacgcagtagagacatttttacatttgtggagagaagtataactgcccaattatctcaattacatcaggatgtttactgtgcatagttctgtttttatggacacaagatctacagtttattcaaactatttgataattactcctgctaaagtattattttattctcttcccaatatttgaaaatatcttattagagctaaatatatatgttaatgaggctgttaaaaattccaagtaattacagattttatattacctacaggaatttcatgtattactttacaatttttatttatttattctgaagttcacctcagtcccacaaatgggctttcttcttcaggaacgaatttagtagttatgatagtgaatgaataatggtaattgtttaagccaggtgttgtataaagatactggaaattaatccaacaaagagctctactaagaaatatataaatgcctcaagcttcagttttagactgtgtctatttcatcctgacttcctttgacacttcagtagtgtctaaaatttgtgcctaattcccagagatgcacctttaattatgattaaagaaagcaaaattttcatttctcctttaagacatatgtaatctttaaattagcttaacaaagtcctcattatgtaagatttttggacttacagttttggttttaatcaacactattgatattgttgataacaattgtgttttctatttctatcaatactttttatattttatttatttatttatttatttatttatttatttatttattttttgagacagagtttcactcttgttgctcaggcgggaatgcaatggcacaatctgggctcactgcaacctctgcctcccaggttcaagcaattctcctgccacagcctcccgagtagctgggattgcaggcatgcgccaccacgcccagctaattttgtatttttagtagagacagggtttctctatgttggtcaggctggtctcgaactcccaacctcaggtgatccgcctgcctcagcctctcaaagtgctgggattacagttgtaagccactgcacctggccaatacttttcatattttaaaagatcaaaacaattgaaaactaatagttcctttaatctatcatttgttaattgctacttgtcttatttagaaatgagacttttatcaaattatttcaagattctgattcacaacaattttttatcagtttattgacatttatattatcattattattttatttcaatagcttcaaggggacaagtggctttttgtcacaaggatgaattttatagcagtaaagcctgaaattttagtatacccatcacccgaatagtgtacattgtacccaatgtgtagcattttatcccttaccccattcccccaaatctccccgcttctgagtctccaatgtccattaatgactctgtatgcctttgcatacacacagcttaactcctgcttataagttagaacatttggtatttggttttctattcccgagttacttcacttaaaatcatggcctccagttccatcacaatttatagctaaagaaattattttattcttttcttatggctgcacagtactccatggtgtgtgtgtatatatatatatatatatatgtatgtatgtatgtatgtatgtatatatcacatcttctttatccactcattgcttgaggggcacttagattgttatctttagagttttgaattctactgcaataaacgtatgcatgcaggtgtctttttgatataatgacttcttttcctttggatacataactggtagtgggattgctggattgaatggtagatctacttttagttctttgagaaattaccatactgttttccatagaggttgtactaatttacattcccaccagcagtatataagcattccctttccaccacatccacatcaacatctattgtttttattgttttttaaataatggtcattctggctgtagtaagttggtatctcattttaatttgcattttcctgatgattagtgatgttgagctttttttcatgtttgttagccatttgtatatctctttttgagaaatgcattcatgtcatttgctcaccttttagtgagttttttttcttgctgatttatttgaatttcttgtagattctggatattagtcctttgtagggtacatagtttgcaaatatttcccccgattctgtgggttgtctgtttactctgatgattatttctttttctgcgcagaagctttttagtttaattaggtcccatgattcatttttgttctcattgaatttggttttggggtcttagtcatacattctttgaataggacaatattcagaagtttttcagatttttttctagaatttttataatttagggtcttagatttaagtctttaatacatctggtgttgatttttgtatatgatgagagatagagatccagtttcatttttctacatgtgtttatccagtttttccagcaccatttattgaatagggtgcctttcccccagtttatttattttttctatgcttccttcaaagacaagttggttgtaagtatctggctttatttctgggttctctattctgttccatttgtctatgtatctacttttataccagaactatgctgctttggttacgataggcttgtagtatcatgcaaagtcgggtaatgtggtgtctccagatttgttcttttcgcttaagactgctttggccattcaggctcttttttcattccacatgaatttgagattttttttctagttctgtgaaaaaaagtgctgatattttgataggaattacattgaatgtgtagattgctttgggcagtatggtcattttcatgacattgactcttccaatccataagaacaagatgtatttccatttgtttgtgtcacttatgatttatttcaatagtgttttgtagttctgcttatagcaatctttcacctctttggttcagtaatattcctagttttcttcttcttcttcttcttcttttttaagttattgtaaaacggattgggttcctggcttgattctcagctgtcagtgctactgatttatgtacattgattttgtaacctgagactttactgaattcatttatcaaattcaggagtcttttgaaggaatctttgggttttgtagctataaaatcttaccattagtaaccagaaatagtttgactttcttttttccaatttggatgccctttatttctttctctcgcccaattgctctggctgagacttccagtacagtggtgaatagaagaggtggaagtgggcatcctgtgttgttccagttcttaggggtaacactttcaacttttcctcattcattgcgatgttggctgtgaatctgtcatatgttgctttcattattttaggtatattccttctatgactagttttttgtgcgtttttcataaagcaatggtagaaattactgaatgttttttctgcatttattgagatgatcacatggtttttgtttgtaattctgcttatgtgatgaatcacatttattgacttgcatatgttgaaccatccccacatccctgggatgacaccgacttgatcttggtgaattatctttgcaatatgctgttggattcagtttgctagtattttgttgaggatttttgtatctatgttcgtcaaggatattagtgtgtagttttctttttttgttatgcccttttctggctttagtatcatggtgatactggcttcatacaaaattagggaggattctctcctttctcagtcttttgtaatagttttagtagaattggtaccaatttttctttgaatgtctggtttaatttggctgtgaatcagtctgtttttgttggcaagttttttattattgattcaatatcattgctttttactggtctgttcaggattcctatttcttcctgattcaagctaggaggagtgtatgtttccaggaatttatccatttcctctagattttctagttttgggcatagaggtgttcgcagtagtctcaaatgagcttttgcatttctgcagtgtcagttgtaatgtctccattttcatttctattgagcttatttgaatctttttttggttaatgtatccagtggtctattgattttgtttatcttttcaaaaaaccaacttttcatttcattggtcttttgtatttttttttgttttcaattttatttagttttgctctgatctttgttattattttcttctgctagatttgggtttagtttgttctgttcttctagttccttgaggcgtgaggttaggttgttaatttgttgtctttcaggctttttgatgtaggcattagcactaaccactttcctcttttcactgcttttgctgtaatccagaagttttgataatttgtatcactgtttgttatcacatatttcaaagaattttaaaatgtccatcctgatttcatgttaacccaaaaatcattcaggagcatattgcttaatttctatgtatttgtatagttttgatgggttcttttggaattaatttctagttttattctgttgttgtctgagaagatacttgacataattttgattttaaaaatttattaagtctttttttgtagcctgtgatatagtctatcttggagaatgctttatgtgctgatgaaaagaaggtatattctgcagttcttggatagaatattttgtaaatatctgttaggtctatttgctctagaatatagtttaaatccagtgtctctgtttactttttccctcaatgatctgtctattgctgtcagtggagtgttgaagtcccgcactgttactgtgttcttttttgtctcttttcttaggtctagtagtaattgttttataaatttgggagctccgtaattagatgcatatatatttaggattgttataccttcttgttgaattgatctttttgtatcattagataattaccttctttgtctttttttttttttttttactgttgttgctttaaagtccgttttatctgatgtaatcatagctactcctgctttggtttccatttgtatggaatctctttttccatccctttaccttgagtctataaaatttcttaccagtcagatgtgtgttttgaagacagtagatatttggtttgtgatttttttttttatccattctgccaatctgtattttttaaggggagcatttaggctatttacattcaatgttaatattgagaagtaagttactgtgacagtcaacatgttgattgttacctagttactttgtttccttcattgtgttattgttttataagccctgtgaatattatgcttttaagagtttctattctggtgcatatcaatattttgtttcaagatttagaactccttttagcattgcttgtagggctgatctggtagtgacaaactccctcagcatttgcttatctgaaaaagtgtttatttctccttcatttatgtaacttaattttggaggatacaaaattcttggctatttttctgtttaaggagactaaagataggacctcaatccctattagcttataaggtttctgctgaaaagtctgctctgagtctgataggttttattttattggttacctgatgcttctgtctcatgtcgcttagaattctttctttcacattgactttaaataatctgataactgtatgcctcggtgatgtcttttttgcaatgaactgccaggagttctttgagtttcatttatttgagccatgaaagtttccctcaattattttctcaaataagttctccaaatgttttgcttttccttctccctcaagagcaccagtgattcttaggtttggccattttacataatctcatatttcttgaaggctttgttaatatttttcttaattcttttttcctaattttggtctgcttgggttaatttgaaagccttgtctttgagctctgaaattctttcttctacttgatctagtctattgttgaaactttccgctgcattctgggattccctaagtgtttctttgattgccagaagttctggttggtttttctttaaaatatctatctctttagaaactttttcattcatattctgaatcatttttaaaaatttgtttatgttggtgtctacctttctcctgtatctccttgagtaacttaatgatcaaccttttgatttctttatctagtattgcaaagagctcatcttggtttggatccattgctggagagctactgtgatcttttggggatgtcatagaaccctgccttgtcatattgccagaattctttttctggtttcttcttacttcttccaaatatttttgaatttatatttgataattgtattttttaatttttttccctttgagaatataactttaatgattatggtttattgtaacataatttgcctctgagtgctttcaataatgaagactgcatatgaaatctttggttacagacagtctatgtataatggctttctccagtgatggttgtagtagcagtatacttggtgtgtgaaacaggttcactgtcttccatgggaccagaataacagaggtctcatgaagcttatcttatttcccagtggtgtgaaattcattcattcattcactcattcatacattcattcattcattcattcttccagtattctactcactgggttgaacagttcaagtttcggcccagtaagaagtgtctgtaggtaaaaactgcttgcagctgaagcaagtggataaacacaataccccaattgtgggcagaggtcccagccttgacagaaacagccaggagagttctcagttaaacacactgaggtctttacagggagaagagagggagccatctcagctcccctaccacaccagaaggaaagctttccacctcacagtcacacttctgacccagtgttctggttattcagatgagacaggcacctcttttcagctgcaggaatgctgatgtttggtgtagagagagattgtgactctactcctcatgcaagcctgaacctagagtacactcctcctgtggggatgtagtcaccctgaagtgttccagagagtctgtctatgggtgcacctatgtcaaaactctgtgtgtctgcagtggtgagtgaggaggagaataaattcccttcttcaaaacccttcatgagtaccagggctgcctgaccactggagatacagtcatagactttccccactaggcccaccagcacacctgtgtctctgctgaaagaaattttccacaagcgtaaagttaggaaactcaaggtctgcagtctgaattattttgtctcacaaggtactcctttgatgaggtgcacccccccttcccttaggagtaggggatctgatgatacggctctgatgagtggaggaacaccagggctcttgtctcatgccgaattagataaggccacacggacacacgtggagtggttttaaggagtagagagtttaataggcaagaagggagggagaagaaagaaggaagaagctcccctgtacagagacataaggaggagggctccaaggctgagaggagactccctgtgccacggaaaagtggctgcttatatgagtaggctggaggaggtggtatctgatttgcatagggctctggggattggtttgaccaggcatgtcactcatgtagtgcgcgaaaaacctcgctctcacaccctagccttctagtatgcaaatgtggggcaccatgatgttctacacgtatagagatatgtcagggtggccatgttgccaggcacttgtgggggcaagggcagggagaagagcatgggaattgccatgttttggtggaccgagtttctaatgcccagcatttgcatatcaaagcttgctgccaggctctaagatctggggctttcctgctaaacaagaaacatttctggagctgctttaaaagagacaaaaactttccaaggaccccttttcctctctatctgcctaaaataatttcttaataactcctgtcacactaagggacagactactgtgaatcttgctgctcctctgggtcttgctacccagtgaagctgccacactttaggctgggaatttctgcaaggaatccagtgatgtgacttgttctctaatctcccagcactgagtaccagcgccagctctgatgagggtggcaggtgagtgacacagactctgtgaaatttccttggttataaatagccttagtatattggctttctcaaatgctagttgtagtagtaatgagctggttgtatggacagactcaagacttcctgattagccagggtgatgcaggcagtgttgatagctgaggtcatgcaaaagcttcctcccttcttggtactgtgtcattctgcctgcagatgctataatgaactgtgctggttggcttccagccaggagatggcacttgcaaaagagcaccagctgtggtagtagcattaggatttgtgcttgccctatgttacacacgggaggtactctggtgtctcaggcaatgggtggggccatagagcttcaaaaagtccctgtcctttgtgttaagctactgtgatgagtggaggggcaaagccaggtgggggttgggttaggcaagttcatattctggcttcacacatgcaggagcaagcagaggccccagtggcatcagagggcagttctctggctactgagataatgttccaaggaggagcgccgctgcctctgctgcacaaaagaatcctcatgtggaatggagggtagcaggcagcagtaagctccacccagctcctatgcacttggtgagtgcatagtgctaatggaacccacagtgatccactagcagcagctagctggggtccaggcagcctgtgcttagaaccccaagctgccccaggccacgaggcttcctcattgaaacagaaatcatggctcttgggccacaccacttcccttatgcccctgaagcacggtgcccagatccctcactgtggctatatattgcacacttcacacttgctccttggttttggctaagggggttagcccccattcaagattatatcatgaatctcagttgggagcttctctcactaacttttttttttttgagacagagttcactgcaacctctgcctccaagttcaagtgatcctcccacctcagcctcccaagtagttgggactacaggcacttactagaacacccagataatttttgtattttttttttttttttttggtagagacagggttttgccgcattgccaaggctgaactcctgaattcaagcatcagcccacctgggcctcccaaagtgctgggattacaggtgtgagccactgcacttggcttctcaccaagtcttgcctcagtgagctagccgacttctgggaggtaccgtgtgaggcaggatcaggaatggcttctcactgttcctggagaggctgggagtgcatgcaaagtacatcccaatgccactccttctcatacactcccacttttcagtaaattagttccagtgctgggtagggttaaggctttcccctgtggcttggattgccaggttccccagtgggggtgtgtatcccagacacagtctctccctgctcatactctggggactcacagttttctgcctggctcacaatgtaggctgcagcctgctgtttcttttaaagggtctgcggttttgtacagttttcctgttaagttcccatactgcttcatgggaaaaagttcacagcatgaatctctacacactattttgtttctgcaagtgggagaggaatgctaacaatgcttcggatctgctgtctttgggacagcaggggcggtgtgtgtgtgtgggtcggggtgggtggcaggaagacatttataagtatttcacactaattagatttttcttttttgaaaagtgcatattaaaaattatttgtgtggatacatttgtcagttctgggactgtcactcatgaagtcactgcatatgaccattgtttctaaagcagcctgcaaactctctcattgtgcctttggaagtaaatactggcttccttctgtagagactttaatacatgttttaatttttaacagacagtacgtcagattttaactaccgagacttatctttttaaattaatcttatggggttttcctaattatttgctattgatttatttaaaattttctgagattccaataaatactaaggcctatcaatactattaactacagggtttttatatggcttgtttcttttacctttccaaagagatctttgggaaatataatttaaatatttaatatgcaataacaacaattatattctaacacttattttctaatacaaagccccatctttgattgaatccatccatcagcttagtgctgtgaagtgctgtttaaaggagacattaaaattgtgtggtgccttcacaaattcatgatttccagcccagccagagctctgtccacatttctacctggcaatccttgaagttgtttctagtcagatcattctcttaatctcttggcaattatcctaatcttctatcttttcctcaagatcccaattctacaaatattcttctcagtaaaacattactcttatttcacagaaccaacaaggatgaacagaggaaaactccatcagtattctgcctaccctgaagcaacgtgttttgactggcacctgttattcttccaatttcaggggaacagtgactttctttctgttcgatgttaacacttccttttgtgctcacagtatcacttctcctgacccatttcttacttgaagactctcaatttttcctctcccagctctttcctgtctgcacataaatttcgtggttctctacttgaagtgttacttgagggatacttttaaatgatacatactttctctgtaattgaatgaaaacctttttgctatttatcctaagtctttttcttagtaacaaaagaccttctttcaatgacattcctcaaagaagcttgttatacaaggtaacttacaggtgactttgcttatggcccagggaattttagttttcagtcagcttcaacaacatttcctgacttagaacctgcatcttaataactttcccctgggattcatatgcacattaagcttgagaattattgatttaggacagtggttctcatcactggctgtatattagaatgccctaaatatctctctaaaattaacaccaaagcctggacattttccaaaccatctaaagcataatcttagaaaatgataggccctatgcctgcctgcctgcctgcctgcctgcctgccttcccgccttccctccttccttctctccttccttcctcccttcctcccttcctgcctccctccctccctctctccctctctccctccctccctccctccctccctctctccctccctctcttcttcctccctccctccctccctctatgcctcccatctctgttctttcttttaaagcttctcaggcagaattctaaagtgcagcctgggtagagaacaattagatgattatgagtatttttattttcagcttttattttggattccagggatacatgagcatgtttgttatatgggtacattgcatgacactgaggtttggggtacaagtgatcctatcacccaggtagtgaacatagtacccaatatgtagtttttcaacacttgcccccttccttgtctgccccttagtagtctcagtgtctgttgtttccatctgtgtgtccatgtgtattcaatgtttggctccgtcttataagtcagaacatgtggtatttggttttctgctcctgcaataattcatttaggataatggcttccagattgttgatgattcacatatgcagggtttttaatatgctacttactacttatgtcacctgcacacattagttaatgtgtattgttttaactatctcatctgctaaattgtaataataatacctacttcaaagagttgtgctatcagcacagtgcttaaagctgtgtctcatggaaagtaactaacaaaatggtaactgttgaaattatatcatgtttatcgactatatggatttggtatatctaaataaggaaatggctctatttttctcaagcttcagggctttgtatcagtttaatttggttccaactctccaagatttcattaaactgcaatttttattctcatggctttgtagaccaatcttgcagcttcctacatagacatagtgtatgatatttttctctttttttaatcagagaacatcataacatgttctccggtaatttcagaaaaacatctcttcttgctttttaaagtctttctagcaaccgctgctcggttttctgaactttataactttgtctattatatcctttccattttggtgaaataattagagacatttattttatatctttggcagatgtagggacaggatagattttctgcttattttgagatagggactgattttaccatcctgaaaaggagaaagtgattttccccacaacaggaatagaataagcacattataaaatcataatttaaaataaattaatctcctttagtaaatctctctaggctggtttcagtataaatttgttccatataataaattactttcagaaataatttgatacccctgaacttaaaagtttaaaaaataatttaaaggaaaacaggtatttaataacataatgtaggcattgaaagtcaaaatgcctgccattttttttttttttttttgccttctatcttggaataaaagaggaaaaggacaaaacataacacacttagcaaaaagatcaaagcagatgatcagcaaacaatgagagattgcagaaaaattatggaagagagaatgttggtgggacacattgaaagactaaatgtttgggcctagaagctgcagctcaaaatacttcatgaagaacctgcagtggagagcggctgtcattcacatctcctctgcagttcccaggggctctgatctcagagctagtgagtaagagggagtggcacatgtggctataaataggaggattacctggaggtctgtgtaaagctctattttgttagttagtacacctacccattgttaactcagagcaccagcactctgataattagcacttgggatggaagcagtaactggggactcttctaaaaaggagttgaatcaaatgggctctttgctagagtgcctataatcacccccttgccttttctattcctcactgcagagatatagtggtaaaacctcctcctcagagagagatttgatgtggaaaaaaaaaaaaaaaccacaacacaacagcagaagaaacccacccactgcttccttccgtaatttaaaacataccatcaagaatacctgggtatagtgcagaccagtagcacaaaagacaatggccagtcatagaaaaagaggactaaggtaatagagggtaggaaatgatcatgagaaaatataaaataatttctcatatgtgaagaaattgtaagtctttgcactgaaaggacctcttgaatatccagatcaatgaataaaaaaattacctccatttgaggacattatcttgaaacttcagaattccaaggacaaacataagaacgtataagcttccaaagaggaaaaaataaaatattaatttcaatagaacaaaaatgaaaatggctgtaggcatttctttaagactggatggtggacaatagagcaataaatttatatttctgaggaaaatcaaattagaacttagaaattttttccaatcaatctcaatgaagcataaaggcagaataaaaataatttgaggcatgtagtgatttagcacataaatcttccacatgctctttctgtgactatcttgagtatccattgggctccaggaaacagtagctcaaagagggctggcagtaaagggcagcctaggctgatagctgtgcagagggcttgggcagtgacctgtccagacaagagcagcagacccctgggaaaagtgagagaatctatgaaatagataatgcatgtaaaatgactgacaatgtagagacaaaatagaatgatatgtatgttacttatagttttagatagaactaccaaaaatattgacaaatggctacaagaaaaagtcttttgaaagcgaaaacagggttgatgaaagacagggttatctgttctttagcctaagctcttctatgctatttgattggtcattatgtacatgaattcactctgataataaaacattcaaaacattaatttgaagatttttaacaaggatttccaagttatatagatggcttctttcctagactttttgattttggtactcattctctctcaagtttatttgtatgtgttttcatttccttaccatattgtatgaaccatagttttatttatttgtaacatagttaatttgtaacatattcttatttacttatatatgattttacaaactacaagtggcatttttataatccttgaagtatacaatgcaatataaaatgaataattgatatggctctgatgactagagaaacatcagggtcctttgtctcatatcaataaaattagcaacatggacgcaggtggagtggttttaaggagtagaaagtttaataggcaagaagaaaatagctgccccatacagaggtaggggggctctgaacagagaagccccacgtgtagtagaaagcagtaggttatattgggaggctggaggaggcagtgcctgatttgcatagagcccagggttttggtttgaccaggtgtgtcattcacgtagccagtggaaaaaactggccctcccaccctagtcttttaatatgcaaatgtgggttgccatgatgtcctgcacacgtggtgttatctggaggtggccatgacacctggcacaggtggtacaaggagaagaggatgggaacggacatattgggtggacctggtttctagccactggcatttgcatatcaatgcttgctgctccggtttttcaaacttctttcggttagaaaggaaatggtttgggggttgctttttcctttttttttttttttttttttgagacgcagttttactcttgttgcccaggctggagtgcagtggcacaatcttggctcactacaacctccgcctcccaggttcaagcaattctcctgcctcagcctcctgagtagctgggattacaggtgcctgccaccacacctagctaatttcttgtatttttagtagagacagggtttcatcatgttggccaggttggtctcgaactcttgacctcgggtgatccacctgcttcggcctcccaaagtgcagggattacagggtgagccaccgtgcctggcctaggtggttgcttttcattaaaggagaatttcaccatgaactttcaccctttctagctacctaaaaattatttcttaataactcctgtattataatcattgaaatgagtagttgctggtgaaggatttcatgctgcaaaatcttataaaacatttaatagtattattaccatgcattatttgaattttaaatagtttcaaatcaaatgaataagattttaatgcagaataattgcattaataagaccttagatgcacttttaaaatatatttttaaatcatgtaaaataccatgcctatggcaagaaattagtaatattcaaatatctgatttactctgttttatggaaatcaataaaagaaaaacggtaacacctgacacctgagtgagcaccagtgccattaatttaaattctctgccttagctatgttatttgctactacattttgatattgatcttttattatgtgaatggtgtatattaggcattaatatagaaaggttttcttaggaaaacttttagttaagcccataagttaactcatgaaaataaaaagtgggagaacattaattttaattagaagtatttggcattttactcataagctgcgtgtattcccttttaagttaatgtttctgccagtaagaaggcaaagtggacactgttgcctgcacaagtgaacacagacctccctcttttctcctccttaacagaattctgtgttaatattttttctttccagctactcacactaacaccagctctatagagccatcctgattagtaaactaacaaagacctggcattctcctagtgattgaggtgaaatatcccagattaagggaattaaaagaaaaattgatagttcattgctggagtcaaagttttgtctcttgctgtgtatgaaggagaaagtatggatcttccactgccactggtaggtatgttgtgacagtagtaaactagcttgaggatgaagtcgacttgattaatggtgacaacgagtttgattgacactgaagacccacaacaaagctgagaccagaaaattttaggagatacttactctgtacttgcatcaccctagtccaggccctgacccacaagactcaaatgacagtgcttacaaatctaccctttatttcaggaacaagctacaatagcataacagtgttaaagtaaggatatgaatcactgctgaaggctttctctcacagcaaggagtcaccagacaccaggttcaaaatccaattcttcctctgtaaaggtcttcctgacatgctatcttggatcagaaaccacctgacgtgtagtaaagcccctcaaaactagggtgcccaaaatagagtctcagctgggatttcttctctgctgatggcctaaacgtatcgttgctacataaccagcccaattggagtgtcctctgggagtctctgggcacatcatcaatcctgagaccaggtgcatagatagcatcaatctcactgctatctctgagcaatgcaaacaagccggtacatgctgcatgaaactccaacttcatggttacaaggttacagtattcaacagtgtgtttcatacattgattacagtgtctgaaggtgcaattctcatttcagtaataacccagaccaattccaggcttgctagaatgtcgcactgaccctagaaaaacagacacatgattatttgatgacagcattaacctgctaaccatctctgaagccacttcttctggttttgttgttgttaaaaaagacaagcgatttatgtactgtttaaactgctctttttagagtttccatttctgtagctaaaagcatcctagcttatacaaaaggtaaacgcctcctttatctgcagctatttaggaacaaaaaagatagtaaacagggcaaaatgctaaccaagagaaaaggctatatctaggaaactgctgactcacgctttgccaaatattttctttggtactcttttatctaggacaaaaacctttggtttgttttcagagacaagtagatgtgcttttgaaacgatcctacaatatgtaaaatgcatgatactgtaaattatttgggtccatggtatcattgcttattatgtgtaggttttgtggaagaatatacttaaatctagctctgataattttaaatattttatctctacatgtttctcttttgtagacttctattttgataatagtccatggcatttagtttcacatttactaatttcataattactgagttgactttaatttttcctacagaaatttattatcaaacacagtttaaacatttctttgcactcagcaaagatttatgcagtggcatctgtaattttaagtaacagtttggttaaagaactacatattcatgtatttataacctcctctgaaatcaaactgtcctttgtcttttagataatcattagaccaatgaaaagaattaaacattttggcctatttctctataactgaatgtttcactcttgtaaatttttatgttgtaaaatacttcaaactttattgtaaataggaaaaaacagagagtttaataaagcaaattgcatactcaaactctggaaacaaatatttcataggaaggcaatttggtaagctgtgtagtggcttcttgctcgaactgtgctgctgttctaagtccaagtctggaacggacttgagcatggactgactggaatagaatggactgagaagcagagattgacaccactgtgggaaattttaatttccctttctgatggtggttatggcagtaaaaaaaccaaagccctgtctgaatccttttaatggatccaaagtactggaaaatatatagagatgaagacatggttgccaccaaatctggactggattttttttaaaaggctgcaaatttcactgcctcatgaattttgaacttgcataacttatttaaaaattttggcctcaaataaatatcatgaattaggttttatttagagttgttgcccatcaagttgatctgatatgactgttataacctaaccaaatgtttcttttaaaaattcccaatgtacataaaatagaaatatttgtaaaaaatccataaaatgagttaacatataaaggcagtatgcagggtaatattattgaaattttcaaatcatagctggaactgtagtctaatttcaatatcattgtatatgattctacattctacaattcttatttacatattaaaacaagaattttattatctttaatgatgatattcatatatgacatctacaaaactcaatatctattctaaaaagtgatgacacatgataagggcttctttttaagtagagaagttaaaaagtaaagactctcaaattatgctaaaaataaaaatgagtaagaagtaatctggcaagcatgatggcatcataaaatatagtaccaaattaaacctcaaaagcctggcttttagcctagctttgccaatgactatgtgactttgggcaaactgtatcactgccttattcagaatcctatattttcaaagaatggataggaccatatgtctcttatctatctctttcaattttttaaaaagtcttagcttttattattaataaatggccaaaactacctaggtcgcaagggtttttaaccatcaaattatgctaatgactacagtcacattataagtaccaatttctcagttattgtttacatgcatattgaatactgcagaatttatcttggccatctgagcctaacatcattatccatccctctagctagcacaacagaggctgctcctactgctcctgctaacgctgccttaacatggacactgttgcttctgcaattaccaaattttgtcctaatttccttgatgcataagattaatttcaaattatatttcaaacgcatgtcagtggtaaaaggcggcatagtggtaatgcccctcctgccaagccccatgcacagtggtgggagaataatcccccatgaggacaccatagaactcttagaaagtgtaggttacatacggagtggccaacacctgcttaatgtctcctcaaaagattactccattctgttgaatgctaaggtgctgtaatcttgatagaaatgcatagattttgttgctggtgttttatgaggattaaatttgaaaattggtttaaatgtaacaattacattgtgctctgagtaattccatacatccaacatgcaactaccaaagtgcagcaactctcaatgcaatgagaaagacaggcacaaaaaagaaaactacaaaatgctatgggattacaaaaaaggaagttatgatctctgcattggcaatttagagaaatggtcacagagaaagtaacattgggagtgagaattttgatgagttttagaagttcaacaattaggcaaggatcaagtagaacatttacagggagtggggatagcatgtgaacttcagtgcagaagctgcaaaagggagaatgatcaggacaagtgcttgagaggtaggaaagtattaggcttgtgattgaactttttatgccatgatgaggaaactgcgcttcatcttttaagccttggaaggtcatagaacaccttttagctgagagaaaacatgatttgacttgcatttctgaaacagcatatcaccatataccaatagatttctttacaattgctcagagcatactttaacccttttgcataaagaataataatcaagttgaagataccttaccgacaaaaaaagatataaaaattaacagatgtttaatttattcagcaggatttgatttacttagttatacagctaattctcattatttgcagtagttacattgtataaaattgctgtgaacatggaatttgtcaatgctgaaccatggtgcttacagaaaatacagggctagatttctgtgagcttctgatcatgatattttttctcaaccgatcaattaataaccttgttttatatgtgtttctgtttgaagacatcttatttaatatatattatcattaacattgaactcaggtgcaacaattcagtcctgaacaaagcttatccaacacacacacttcctctgtaaggcacatcatagccgttttgtgcttagaaacaccagacagtacttcagcactacactcaagagacattttaaataccaaaatcacccacaaaacccacaaaaatgtaaaacagtgatgctaaagagattgcaaaagggacacttatttatagtatgagagctaaaaaaagaaagcagaactttgccttgtgtgaccttagctggggacatgtgtatcctggcctctgcacatgtccctgaatgactgccaaagccctgcaagtattgattaaagattataaatacattttagtaagtaggcaaattcaaaaatataaaatctgtgaatgaggattggctgtataattgttaattttaaatagactttaaaaaaagatttatttctttgatgtcaatagacaaactattaaaaagagtattcatagaacatttgctaggcaaaaactgtattcagtctgctatcttccaaaacctaacgcagaagatattttgtttgcatggagttcactcatagggaagatatttctgatattaataatatatttaaaaaaagaaagataaattttcactctgaaacattgaatccagtcagttttcattagaaaattttatattttcaccattcatattcaataacatacaatagaattttgccttaggtaaagttcttttgaaatatgtgttatatgtggttttaaaaatagacgaaattatcaatgaacattctctttatatttctgaagtgtaccaaaaacagaaagaacaataaagttctaagtaaaggtttaaatatatgtcgctagttgataaattgattagttaagttgatccttagaagggtaaatgaaaagtgagcaataagtctcaataactgtgttccaattgcctttcttttgcaaggatttcttgctaatgttaatctatgaagcaatggcttaacagaaatacgtatctcaccttgctcaaaataatagcttgcttttcccagccaagaagtcaaaacaataggagcacaaatgatacatattcattagtaccaattaaatagtgttcctaactagggtacctcttcctaaaatgctataaaatattaatctgtttagctgtcgaaaaatatttttatttattgaagttattgttcagctttggaaacaacataactcatttatagaagtgataaggatgtaacaatttcttattgacaactaaccgtgttcctttacatgttcatttataacttattcttttatctaataatgatgtaaaatccttttgaaaagtaattgtaagtactgaaaaagaaaaaactaaaaaatgaacaatgcatatttatgttttaagttggatatgttaattagcttgattgtagtaatcattttactatgtatatgtatatcaaaacatcacattgtataccttaaagatatgcaagtttttttgtgaatcatgcccgataaagcttagaaaaaacaaaaacacacaagagggagtttagaaaggttcctgacactaacataaaagattaaagtatttagcaagaaactctccattaatacttgtgagaatcattaaggataatattgaacaataataataattagccatatgaaataaatagtttcatcttagtaaacttgattttaaaatgaatatttgtattctattagataatttttggtgtcttagctaatttgagccaaatatgtgaatttgtagcataacctaacctaacataattcaatacaatatattataataatgttaacaactttcagctttctttctttgttatgagaaacctattcttaaatcacaaaaacaagggattgtcatattaaaccaaaacaatatcaagtataaaaccataattcttatattgttgtgagttttagaattttaaaatttccagtgtattcaaagacttcaaatttagcatttcaatccctgaaagtcataatattggtcatttttgttattttagagattagaagcctataaaaagaacttttaagtaaacataatattaaagacacttcaatgcaacatcatatatgaagtttctcaatgaggaatagcactttctgaattttaactttttttcaaggatttacaactgatttttctttaaagaaatctataaactactgtcactcagaagtaaatgatagaatgaatccataacaagctatgcttggcgtataataatagtttgggaatattattaacatgaccctctttcactacacatttacataaattcatctataataagctgtcttaatttatgactcatagcatgaagattatatattaatgttgagtaaaaagatttgaaattaccttctatcttgattctttggaagatttacttatgataaacattttgtaaggagtggggactattgatctctaactccaagtcagaattttccaaattattttcacttgaaaatgtaaattggatgatagttatagacaactttgatctctaaagttaagtttaaaaatcactgtggaataggttcttaatagtatgcttgagatgaaaagaaaatatttacttgtttcaaatcaggtcactaaaatgcttattttttaacaacgtgatccaaggccgggcgcagtggctcacgcctataatcccagcactttgggaggctgagggagcagatcacctgaggtcatgagtttgagaccagactgaccaaaatggagaaaccctgtctctactaaaaatacaaaattagccaggcgtgatggtacatgcctgtaatcccagctactcaggaggctgaggagaatcgcttgaacccgggaggtagaggttgcagtgagccgagatcacgccattgtgctttagcctgggcaacaaaaacaaaactccatctcaaaaaaaaaaaagtgatccaaaactagtgaaatacgacatgttcctaattttttcatttcctattctttatcatctccatgaaattgagatagaaattattcctatttcttaaatcttcaaatattgatcataataccgagtgtaattttcgattataattccattccaaaattatatatttcatcttgtaagattcttttagactgcttaatcatagtttaagctttatccagaccatggagtcttgtggttaaaagtgggggtttgtagagagagatgcctgaatttatttccaactgtagcactcagccttagctttgcaatcttgtcatagtaatttaaacactttagttgtaaaaaactaataaatatttcctattttatgtattttgttgaggaataaataattaggtaatgctcagtttactcactgatgtagagttagtgttaaaagggtgcttagattaattttgttatcaataaggttgttaatgttgatgctattatcctaaagttataattaattgcaatttaacaatcataaaaatatttaaatctaataccaagactaaatattttcttgtgtcatgtatttagtcatgctttgaaactcgattaccataaatttatttgagtttacactcaaaattttaaacttaaaaatcacttactacatgactgttttgtaccaaaaattgtgctcatctgtgggaatgaaatgatagacattgcctctgctatcaaagacctcacactgccatagcaatttacaacaaagggaccatctaaacgtttactccattatgcaatgaggaatggaggcatcaagtaaaatgaaaaagtgatttattaagagagtttaatccacttacatgacttacaattaaagttagtttgtataaccatgacttaaatattaacagcaatttctatttttcacctttcacagaactgagcaaatttgactgtattggttctcaaattagtacctgaagcaaatcaatgtctaaagatgattgtttatctttcaaatatagcttatgctcagggtaaacttgtacctattgaatgctaaaggaacaaagagtggtcatctggatctctcagtatttagggaatccatcatctcacaggctcattgagagagaatacaaatcatttagtctccaactttacagtgcagaaaactcttaactatcagaaagttatttctctggttttcaatgagacaaaattccatactcaaaaagccttatatttctatttacatactcctcaatattaaattataatgactttttaattttaaaataaaacacacagaaatagaaagtgtttaacggttttgcctaaagttgtaaaagaaaaatacgcaggactcctttgacggccttacagtgattggaaagaattgagacgagaaggtggttgactttcttagagcatgcattgtttatgaaaaagatgttatctccactagtttttcctcctaaagacaggagaaggtgatgccaagagaattactcaagaaggttggatgtgttgataagaagggaaagactgctttttattgctgacattgagacacctatcaccattaattatatctgagtttacattgcaaaatgtaaacaattactgcatgcctgttttgtgccaggaattgtgcatatctgtgggaatacaatgatatgcattgaccctgccatcaaagacctcacaataccagaataataacagcttaaccaaagacttgttgaccggactaatttgctcccattctatcagaaggccaaagagccttagagagggtagtgtgtttggaatcacaagatccactgtgcaaggactatctcgaagaataggcttttttctgcatctatagtgactagatctgggaaccacaataacagatctcattgaggaatgtaagccagctgaagatgttcatagttttagaagggaagtctaaatatccaaggaaataggctgggattcaaagctaggagtcatcaggtaactgagtaccaccagagttcaccatggctagttaagaaggacagtctgtctttactgcctgttgatgtgcatgtctgcctaccctgagcctacggacaagcaacattagcagtagtggtaactgaaagaaaagagactgaagctttgccataggccatgatgaaaactaaaatgtattttcctttcccttcctcctcctgcaacaccaggggacaagtacagggaagttaaaagcaggagaacagaccgcagctctccttacctctacctcatagaccatagtcaatagtctagttttctttgcgtagtagaagactctttaattgtatgagactgcactttaaaaggaataggactaatagttaattgaatagaggctatttttctacagcatgcgactgtaaagttttagaattggttaggattattaaaagaaccagaggacgctactccccaccacctgccacggcccagagaaaagtggttcaatagagcaccttcggtaacaatcactgttcaaataaaatattcatgtttctcttaaatgaattgggattattaactaaagttattagagaaataataaaattttaaaattctctttatctgtcttgtactctttttcctctagtgcttgcagtggtgtgatatgcacttgtacttctgcactgaggcagggggaaagaaactgcaaactttcttggagctgccatgctaaaaaggattagtgagaaaaggtgttctttatgttctaatgtaatccaacacccactcaggtaggagaacagatatgtgattcagagcagaagccctaggaaaagaacatttctgggatattttttctgccctctcctcagagattttaggcagattggctgtaagtggatgtaatataggtaggagaccagcaggaagcctaattcctggtcggatcacaactagcacaatgcaatttgtaagaaggtatcttgaatactaatgtccgagatctaaattatacctgtatgtatgactttctataattagaacaaggccactttggaaaattaccagcaatactatgcgattacctaagaggtctaatttttttttagatttaactttctttctgatgtaatttggtttgtttcttctgtgactagaaagatttcttcagtttgtgcctgaattgaccttctctgaaccaaataccagattaactccaaagcaagtggaatgctgagacaattaccatgtcacagcactaagcatttacttggaattggaaacaggatacaatagagtctgctttcagtaatttaactgtagagtcaaaagtgatgcaaatatcctatgaagtttaaatctttctcattggagataaggggctgtttattataaccacatcaactaacagatagacaagaatatcatagaaatcataatgaccaatttttaacttcaccatttttaattatgtggagtttctaacatcaagagagaagaaaacgtatgttccttttattagggtagttcaatcacaagtgacattatggctaagatgaaggaatgagtcacctgtactgcaaaagaaccaatttccccttgctaatgtgttgtcagcaaagtccaccagccagcctgactgctgtcatacttagagccagttgtcagactaaattagtaaagtcatttttctttccttgtatgaactgtttatagcatatcaagaaggagaacagcatttagctgcatcatattttaacagaaagaggaaaggttgtggagccagcagattcgaatatataggatttttctttccctttttaatactaaaacataaagatgacatataaataaataatacgtattataataaataataaatatacacatatatcatttaaaaaacacatcacataaaaatatacacacagtaaagaatagaagatcctcttttcttgccatttccaggttgacccaatccccttccaagaaataatgttatcagcttcaggggttatatttattttgtcaatattttttgtcaatctttcattttattaactggatagcccattattaatatcagacagtaatttgcttagcaaatgtcctataggcatttaaattgtttccagtttccccaccaccacttcactcccccagaaaataccaccaggaaaatactgatgtaaaagtaagaactagtttgaattccagttctggcgttccctagacatgtgatttttggtgagttattatcctttgaaagctcaattttttatttgaaagcatggagagaatgctaatcagtactgtggtgagaactaaatgagatgatgtaagcacaacacctgaccttgatattagtgtgaaaattactatgaagaaaaacacatgcaaacaaaatcttcagtcctatatttatattttttactttctaaaaataataaaatcataaactgtaaggagaatttaatgtagcataaccccatagacttttagaggaaaggtgagaaatgaacaaatcacaatatgaattagtaattttttgactggtcattttgaaaatggatttcttggtctgaatactaatctatctgagctaggagtgggggatgattaatattcataaatttcttacagaatgctctgattatgctaatgttctttcaaaatgtataaagagacaagtttgaaggaaaaagaacaaaaataattaccaaaattaagcttaatagtggagcaaggcagaaatatataccctgcatgttgttggctcacagctgacatagatgggcgacacctcagaaaagatacacatactcgtcagaatatcatttataaagtatatttcactcattttgaaagtagagatacttttgtaactagacctgttatagaatgtattatatatatataatgcatctttgtcatatatatataattagataatatttagaataatggtaattaaatatttaggagcctgttagattcattgtaacatatacgtgttgaaagatattaattacagatgttagtaactcaaataccttttcaaatataatttctttttctctagaatggttagaaaatctactcagttaaacatggtgggtaaatataaatctcatttttacacctggcttcagtttgtctgtattcagtaattatgtatatgatatattctaaaaacatttgcatgttaagtataattctattatgtgtagtacaattatattttaggagtgagctcttatttgtaatgttagggtaaaaatactacacatcctcctcaatttactatggggttatgcaccgatatacccattgtaagttgaaaatatcatagtgggaaatgcatttaatacatatagcgtagtaaacgtcatagctcagtttagcctaccttaaatgtgctcagaacacttacttacattagcctacagtgggcaaattcattggacatcacagttcattgtaaagtattggtcgtttaacctcatgaccctgtggttgactgggagctgggatcaccatcactacccagaatcttgagagagtgtcagaggcatattgctggaaaagataaaaatacaaaatttgaagtggaatttctactgaatgcatatcataaagtcaaaaaagtttaagttcaaccgtcataagacagggaccacccgcatttgcatggaaggcaaatggttattatgtagacaactttattgtttcaaatagtacaataaccaaaatactttcttaacaagaaactggtctctgattgcaagaggataaaaggattcccaccctcttctagatgaagaaagaacatattgcctggtgtgtttattcatgacctcactgcttggtagcatttattttgtacctttttttaatgcacatagcggtttttgcttctgtttctcttctgctatctttgtctcttccttgggttctcattcagagctttcatttctctccttatgtcagtttccctggaagtttcctgcctcttcttttgccagagagctagcctattgtgattgtgaccgtgaagtgacttggtaacatacatatttgaggcaggaacaagaggaaagatgcaggtcattcttagaaaagactcccatttacttattcataagtccatacacgtctcttggtacctcttagaaggatttaatttccttagtattttacctggggtgaagataatttattatccaaacgagaacacatttacagtgagcggaggcactaaacagacaggacactgggaaaatgggcacacaccaggactaaactagcacaagtgttcaccgtaattttttcttttttcttttttccttttttttttttttttgaggcggagtctcgctctctcacccaggctggagtgcagtggtgcgatctcggcgcactgcaagctctgcctcccaggttcacgccattctcctgcctcagcctcccgagtagctgggactacaggcgcctgccaccacgcctggctgattttttgtatttttagtacagacgggggtttcaccgtgttggtcaggatggtctggatctcctgacctcctgatccacccgcttcagcctcccaaagtgctgggattacaggcgtgagccaccgcgcctggccgtgttcaccctaatttaaccttaaatttgcttttcaaaaattactcagttaaaacatataaaggaataacattcagactcattgagaacattacaattagtggtaaagtaattctgttgtaacatcagtttaccttacgaaaaactaaagcatcatggttattcaatttcctataaaagagaccaatatatttcattattaacattaataacacaaaaggcagcttagtaaagttggtgtctttgggaaatagcagagaaagctgaagcattaagagagaaattatgatatattccttgattttgatttaaataaaagtaagccacatataatttcttatggttcattatatttaagtcaaaagagtaatttgtgtgttagcttttacaattatatatgaatatcatgttttgacactatgctacattttacatgatgtatttatattgagaccagaatattttactcaactgagggagaaacagaaaagtgttcaatcataaatacagtacaaacattgcatttgcacctgaaatgtgtagtaaaatatgattatttataaagttaatattaaatattagatgcattttagtactgccagctaggtttatgttgattgattttccaaatttactcctttcttactttaaattgtgttttttaaatgtttaatgactaatcttacttagcatcaaatatatgtcattttatacccaacagtgcatgtgtaaaagtaattcttgttcattcttgaggcgtttattgccttaactgggcctctattcaatcataactgcatatagggcgatagcacctagagactatgagggtggaggtgaacaggacatgtgggttcccccatgaatggcatgagtgtctttataaaaggtcttgaggtcaatagctagcccatttcatccccattggctcttttgtgcacttttaacttggtcccaatctttgggaaagtattcagtattttgacgtcaaatacgatattagctgtaggcttggttttgttttggtagaagttctttatcagaatgagaaagtttcttcccactactgtactgtgagaatattatgaaaaattgattttgtgatttttttcttatctattgaaatagtcacctggcttttctctattatactctaaaattgatgaattctcatggttgactttcaatggtgaaaccaaccttgtattactgagatgaactctatttgttcattgatatagtttggatatttgtcccctcttaatctcatgttgaaatgtaatcaccaatattggaggtaggacccggtgggaggtgtttgggtcatggaggtgggtcccttaagaatggattggtgaccccttgtggtaatgagttagttctcactctgagttcacatgagatctggtttaaaatctgtttaaaagagttgtgagatggtatctcatttggttttgatttgtatttctgtactgaccagtgatatttagctttttttcatatgcttgttggccacatgcttgtcttcttttgaaaagtatctgttcatatcctttgcctgttttttaatggggttgtttgtttttgtcttgtaagtttgttgaagtttcttacagatgctggatattagacctttgtcagatgcatagtttgcaaacattttctcccattctgtaggttatttgtttactctgttaataatttattttgctgagcagaagctcttaagtttaattagatcccacttttcaatttttgcttttgttgctattacttttggtatacttgtcatgaaatctttaccaatcagaaaggctattatgtaaaagtaaaaaaataagatgctggcaaggttgtagagaaaagggaacacttatacactgttggtgggagtataaattagttcaaccattatggaaagtagtatggcaattcctgaaagagctaagagcaagcaggactaccatttgacccagcaattccataattgggaatatagccagagaaatagaaattattctaccataaagacacatacatgtgagtgttcattgagcactattcacgatagcaaagacacggaatcaaccaaaatcaaccaaaatatctatagatgacagattggataaagaaaatgtggtacatatataacatggaaaatactctactgtcataaaaaagaacgagatcaggtcttttgcaggagcatggatggagctggaggccaatatccttagtaaaataacagacgaacagagaaaaccaaataccacatgttctcacctacaaatgggagctaaatgatgagaactcatggacacaaagagacgaacaacagacagtggggcctacttgatggtgaagggtgggagaagggagaggagcagaaaagataactatttggtactggattttatatctgagtgatgaaataatctgtacaacaaacctgcatgacacgagttgaactatgtaataaacttttttttttttttttttgagactcagtctcactgtgtcacccaggctggagtgcagtggtgccatctctgctcactgcaagctctgctctctgggttcaagcgattcttgtgccttagcctcccaagttgctgggattacaggcacccgccagcatgccctgctaatttttgtatttttagtagacagggttttaccatgttggccaggctgatcttgaactcctgacctcaagggatccacctgcctcagcctcccaaaacgctgggattacaggcatgagccatctctcctgatcataataaatctaaaataaaagttaagaaataaaaaaataaagaaatgaataaataaaagagcataacaactctccctctctctgtcttactcctcctctctctttcttgcttcccctctcctcccccttcaccttctgccacgattgtaagcttcctgaggccctcacaagaagcagatgccaacaccacaattcctgtacaatttgcagagagccaattaaacctttcttctttattagttacccagtctcaggtattccttcatagcaatgcaaaaacagactaacacattcgtgatgtattacctttgtaatatattgcctgatcttgcctggtaaacatattatcatttttgcatctacgttcaagagggattttggcctataattttattttttgaaatggtattgtcaggttttcttatgagctttactggccttataagatgttgtggaaagtgcttgcttttgtttcttttgtggaagagtttgtgtgaaattaatatttatttattaaatatcttatggcattcaacaataaaataacctaggtctggagatttcttcatgtaaatgtttttgataaatcaaattaaatataagactatgttctttaatattgtatcaaatttaacgttatagctgttaaaaatattcatttcatctaagttctcaaattagtataaaagttattgtggttatacttttattattttactgtttgtatgatctacactaataattactttttcatttctgatattgttaatttgtgttctcattttatttcatagtctaataaatattttgtcaattttgttatcttttgaaagaaccaaatgttttcttattatctttatttttgtttgctgctgatttcattaatatccaatctgatcattttttcctcccttctacttctttttttccatcatcttttagtcattgattttagacctttatatttttctaagatagacattgaagcttctaagtactacttcagctgcatccaacaacttctgatatattgtattgtgttatcatttgctagatatgttttttgacttttcttgtgatttcctctttgaaatctgatttttttgaaatatatagtttaccttccaaatattggggatctacctgatactttatcgttatatatgcctactttgattatagtcttagaatgtactctgtatgactacaatcagttgaagttttctgatacttatgtgatgtcccagcatatgtttaaactggtgaacattttatattcacaggaaaataatttgtactcttcaattgcagttcttagtgctctataaacatctaagtcacaatgattcatagtattgtttatattatctgtaactttattttttggtgtagctgtttgatatggtttagatttgtgtccctgctcaaatctcatattgaattggaggaggggcctagtggcagatgactggaccctgcgggcagatattccccttgctgttctcttaatagtgagtgagttctcatgagatctgatggtttaaaagtgtgtgtcacctccccattcactctctctcctgctctgccatggtaagatgtgctttcttccccttcgcaattcatcttgattgtaagtttcttgaggcctccctctgccgccatgtggaacaatgagtcaattaaacctctttccttcataagttactgagtctcaggtagttctttacaacagcatgagaatgaaccaatacattgttctattagttgctaaaagagttacctaatgtctctatgatggtaaaattatctttttctctgtataattttttaaatatattttgaactgtgtttttaggcacatatgcattcatttttatgttttttgatgtattccattgctgttatgaaatatcttcattatgttttataatgttctatatttaaaagttattgtatctgatataaacatatggaggactagtgtgacttgtgcagaatatcaaaatgattgcatctctgtataatacattgtaccagagaagatttgtctcagtcatacttcatgtatacttctgtctttcctatgaagcgtactacttttaatatttctaattgatggtgattgtgatacatgaactcttcacattagtagctctatactaagcactgcaactgtgttgatctctcttagtagatatcacaaccggtgtggcaactgaacttgaggctaccattatgttaaattgtagaaatatgacattattcatccatcttttgaatgtcgcagaggccaacaggaatcaaacagggatatgattggcacctgtactcctgcattcattacaattttggggatggcactaattgattccattccacctggaatacagtgttacttcatattaattatattggtcttcatcagtggtaggccagttttaggggcttttgttttagccttttctacctcagtagctttgactccacaagccggagaacaaatgcgaaagaagcttctgccagctgctatgatgtttgaattcagaggcaagggaaatgataactgggtaaatctgaggatgcattgtatttagagtaagatgatcttggatcagaacataatttattaactggctcccttcaccacattgaactgaggttccaagatagcattttggatttcctgttactagtgtctgtttagatgctgtatccaacagccctccaaaagtctggttattgtccttttcttcgtaaatggtaaatggtcatagatctttttagggaaagaatagagggatgtttatctgatatacgaagagtgtaaaattgtgtccttcctcaaggggactgagattttcctccaatcaatggatattggatctatgcagtcacttatatctggaccctgagtaaaaaactgtgattttccacttgggtgtctgacatcagtcttctgcttgccagaccatattttttttcttattttgcaagttatataacatccaatcagctgtgttggaacataatgctctttcaatcatccccacagatccctgagggtcagagcaccctgattgctactctgatcttgctgcccattacagtaattacaagtaccttgcctctgatagttaagtactgccaactggcctctaacattccagagttccataaaaaggacatccagttctatctgctcacaccaacctgcacagaaatccactactaaatttcacaaagatgcctctacaccccccacccctctctcaacaccacaaatgtattactgatttacttattgacttacaatggagcattctataggagctcctaaggaaaaaacagtagatggtgaggtgagagggcctttggttttacttaataaatccagtataacatttccacctttttgaacttctgacttcttcctcatttttctattatggcagttctcaaaaaaaacttcacctcatttactgtaggctatcattttgtatgaacttcaaagagattatctcagcatggtactataatctgttccaggtgtccctgccaggtcattgaaccctgaatcacgggtgattgttttcaagttattaaattattttgtcacattcttccttttctggtcaaatatatgtcctttagctcttgtcagtagcacagtaggcaggtcttacagcttctttggggtgtttgctatttccttctgagcaagaatgcacacagctgctgtttgtgctgatgctgatcttgtttaattatatagagacaatacatgatgtggagaggcagatattgaggagaataaacagcaacttgtgagaaatctgcttcaggtgaggtgtgtgcaatgtctctaaacaaggagagactaatcctcctcactccatagggtaagaagctgcatctgacaagccagaaagtctgtggttcagtgacttatgcagtattgagtgtctcaagattgtctactaaatgtacccaccacagatttcagggtcttaaagacattgcttttaaaattggaaacctgttaaagagaattaatactatagcttttataactgcccctccctcatacttagatccttggcctgattttcagcatagtctgacccgtgactgcaggacataggagtctccctaaagatcactatcaccatagaaactttagctttcacaatgttccttgagttgatactggctgatctgcacctatcattttttttccctgaaattgtaaaacagtacaacattttaaaattatcattatcttcatatggagcatgccaaaggttctatataccctgccacttcatagtccatgagcatcttatctcaccataagtgtgaatcttaatcattttaatgctactccatgtcaggggttaccaccactccacttaacaccagaaatggaatccccattgcctaatgacctatgaataatctagctccaaaatcccatcttgggattcaattttttggcatcatttcaactagtgtaactaagtgagcctatatgtctctgaaaatggagccttgggcaaaagaatgcttaagggtatagagagtaggaccagggaaaaaggaaagtaaatacaaaggtattacagaagatacatgttcaattacaagacattatgaggaggcttataaaagcagctcttaactatttactgggaattccagttgtcccttgtccaatgtgtctctatagatattgactattctgtattgctggcattggcaaagtctggtgttaggaggtaagcagtccattatatgagctaagggttatggaaaggtactgtctgagtccagttgaaagaaactggttgaagcctattcataagtagtcactggagtaagaagtgagaccaagagaatttgcaatactgcacaagacatagctgagaaagaaacaccttttttcacatttttctaaacttcctatagtacgaatgttcttcataatgcttaagcaatgccagtataaactactacatacggaaatttgaaaggcatgctatattttatttcatttctttccttttttatttgacatagaataattgtatatatttgtggggtacatagttaattagcatatccatcatcttgaagatttatctttgtgttaggaacatccattctaactatattattgttaactatagtcatcctacagtgctataaacacttgaacttattccccctatctagctgtaattttgtagcctttagcaaatatctccctatccctaccttccccctacccttttcagcctctagtatcttctgttatattttttatatctatgagatcaatttttttagcttccacatatgaataagaatatgtggtggttacctttctgtgcgtagcttatttcacttaacataatgtcctccagttccattcatgttgccacatgatgggacttcatttttttatggctgaattgtgtatgtgtgtgtgtgagaatatatatatacacacacatgtatatttgtgcgtgagaatatatatatacacacacgtatatttgtgtgtgtgtatatatatatacacattttctttatcaatttacatgttgttgaacacctagattgattcagtatcttggctattgtgaatagcactgcaataaacatgagagtgcaaatgtgtctttaatatactcatttcatttcctttggatgaatgcccagaggtgagatagctggatctgaatcatctttgatgatcaattctgggtaaggcattttatttcatcagacccccatagacagcagtttggctcttaaaaatgaacaaagcaaccaaccaaacctatgttttaaaacaaaattagtgacttaaactgtcatatcaatcatttgggttcaaaaataatattgaaatatgaatacgttaaatttaaatataatcagtttattcccaaggaacatgttgttatccatatatatgtctaatgctctttgtctcttaaaacagcagcaatattaaaatatttgttaataaataacaaagctcttgataaatattttctaaaaagccatattttaatgaaaagtcaataattagatatatgaaatcagaataatgaacaattgtagtaaattacatttttttaaactccaacattattgtgatttagagacataggttcataacttactgaaaataatcttgtgtaaatttaaagattttcccaaagtgacacaatggctaggttttcatatttcttaattggtttcattttcctttaatcagaaaattaacatttttatcctgtttacaaacaattaaagctgattttgaaactttatcattgggtcaatgggtcagttcagaaaaagtgactttcttagatgtcagcctctagaattctttacatcagtgaaatttagggagtattttgcttggactaagtgtggtctgtactcccatagttagaatgagtgcagtgaccctttttcatgtcactgacatgagaactaattgatttatgtgttcccattgcctaattagaggtaattcaggaaaaattttaaaaagtagagtagctcctgaacaatctgagcgtgggattaagtctttcaagttcctgaaagggcgctaagcctgcctaaataatggtcgtactcttcaagaaggagctaaggactgtagcttcttctgattgaaaaaaggaataaaactctcaaagacaaagaggtaccacatttaaggcagaaaattctactcttaaacattctctgagagtatttgaactataaacatatggggtaacaaacaaagaaactctcacatctaatacctcattattagagaggacatagaagggagctctcaaaccttgccttaaatccctaaaggtagttttgttacgtgttaagaagacattagaggttccatgagaaagctacctatttcaattaactaagaaagaaaataagattcgaggtgatggatccagaaatacagacatagaattttctccagaaatccgttttgaacttcaaaagcttattacgttttttagtagagagcagtccaaatatactgtgaacaacattgccaaattagagaaagtagatgtcttgattctaggccagccagtcacaaaagtgtggtggctctttactcatatacacactcttcttattttgttttctcattttctttctgtgataccccaattaagacaaatttctgtggacatagactaatgcttttcctagcttctccaaatttacctgccctatatattatccttttggcactttattctgtgttactcgctgttaccaagacagcacatactagtgccaattaagacaactgggctccattcagtttttccttctcaagtaataagtgttttatctggagagaaattggcttttaaatatccccaggtttataagtgtataaatgtttattttattggcaagtttttcataataaaatagtttcttaagttcatgtattgctaggaatatattgcaaagtgctttctcattttgcgattagttctgaacagaagacctaaattaggccattcagatgatgaaaaacactttatatcttcaaattcaatgtggttaaaccattgacctaaattttggaatttataccatatctggaaatagaaagtaggtacaatggattttagttgttttatggaagtctctcatttaattttattcctaatctcttcctgtatgtcttcaaggagtcgtatgcccccatgtcacagctgagaaggctatatcttttccttcccagctgctggttcagtcaatgttgaaagtgtcacaggtcatcactgtggcagggaaggccaggcatccaggctgactcttggctgtgtgattgtttctcagtttcctgctgcatagcccactgaagattccctcagatccttcccattcttctagccagttcaaacttcacatctattgtgtgatctgtccccaccaccatcccctcatacctttcaggagaattccttctacttaaaataacaaaaactgtttctatcgcctgcatggaaaaactgagctggtatatagagaagttatggtaagaatgacagtgaagtagactgatagggaagatacatgatgtaattcccataagtcacattatgtgtctaaggtcaatgactgtagctatgccaagagaattggccctataaccctatatgcatatcaaatactaggtgatcaactatgactatcaatgtactttatcttctaaccaaataaactttatccctaatattcaaaaataaattttatttccttttggctagtgtttataaaagtactaggaaagggatcaaggaaaataacttcaattctttggatggcatttgattaccactctaacatgttagctaggtctttttattatcaatatttgtgagagaaatgttacactgacagatttatggcttaggttaagaatatgcaaaatagtctatatgaattttaaagcataaaagtataatataatagttatcaacattacccaaaaattgtttctgttattttaaaaaattttaacctttgaagagcataaatgtagagccaaaaaaatggtggtcattaatgtagtacaacccttcattttgataatgaaaaaaactgtgacctactccctgtggggtattgttctgtaacgtatggacagagtgtatgttttgtaatgtatggaaacctcacatttttatgtaattgatgaatgatatctataagaagaggattgttctttttggttttgggatctttttgggctcatactcactcattttaagtgttaataaatatttttatttataaaagaattacaaaagtatttgtttatagtattctgaaaagcctgtatatttaggacttttgagtttggtctcctacccagtaaaatccataattcattggcataaacttgtaacatctctttaaaggattttaagaaattccagcactattatctcaaatatgacaatttacatgtggcaagttaaatggcactaccatgcagataggtccattataagaaatttgaatggaaagtaacaaattagtgttgatcaaaatattgctcccaagtaagaattactgctttgaatttccttatttattttataaaaagcctatctaaatgtcacaatgacctaaagaaaatctaacttaaatctcatagtttttactcaaaatatacaaaataaaccatgtactcccttctctctgatcaaaacattgttcttcattgattgagaattcatataacttaattttaatgcagaaacattttatagtgcgtcaaagtgttaatcctgaaatagattctacttacctcagtaagagcatcatatcatcttgcctattctgattacagaaatcaaattttattaaaatatttattataaataatattcctatgtattcagttctaatcttgtcacagataaaataatggagatctagtctccagttagttaatgacaaacttgttgctccagggtgcacaggctcactgctctttccattacatcatatcgctgtgttgtatctcataactggaggcctctatggaaggcaggttgtgtggaaaaatattataagaacattttgtgacataaatgaaattcaggaagtctctaccactcatagagaagttgccaaaatgacaagattgtatttttgtttgtgaaaaattggctggctagtggtttgaattactttttctttaaattcaattatttttcaattttaattttaaaatgtgaagggtccaaaggatatattacatcatcaaattgaactgtttcaagattattccagtatcaatatatttttttaaatacttggttcctaaagttgaccccataagctttaaattattctgagaatattcccagaatatactcttactaatggcttactattagtaatagaatacttttctaatgagcacatttaaacagatcaaaataaaataagctgaatttagtatataagtctctctctcttttttttttttttttttgctttatccctgtttggctgaaagttggagaaaagtaaagtaaaactttctaagtgaaggaaaaatgacttgacaaataagaatactgattattcaaacagcatgccaatctttcaaatgtatagataaggataaattatgcagtgtcctgggtaaaattagaggtacagtggtgaataggacaagatgcctagaatcacaatattaaaagtaagtgaatagtgaagatagacatatacaaagagaagtacactaaaatataatttgtttgaattatgagatacatatgaaaaaacagtaaatgttaggaaggaaggaggaagctgaagtaaaaaaaaatgtacaaatggtgactgcaaatgaaactaacccaattgtcccatagaactgatgtttatggtttattttgagtaaatgtaggaattggccttctgagtcttgaaacatgagaaagttacatttgtcttacctgtgttcctttctcaggaaaccaactatcaggcctctcagatattatcaaggaaatgaaacttaccagatcactgcatctggacaattagaggtcagaacactcacccataatgattgcctaagcaaccaactacttcctgctgtacaactcctcttccttgctcctccctaatcctgttttcctgcacatacttacatttcttccctgctatataaactcctaatgttagtcagtgagggagggatttgggacttccatctcctcagctgcagcaccccattaaagccttcttccctggcaatactcattgtctcagtgattggttttttgtgtggcaagcagcaggacctagactgaacccatggcatttcagtaacacagatatattttatggagataaaagacactgtcacacataaacatagtattaggatcttagagtttaaagagacctttattgtctaaactacagttctactcactgccatgatcctatctagcctaagttctttagaatctaaggaacacttgtagaaactctaccatggggaatatagttatctcaagtctctgtctaaaaatcttgcagtctattttgattgctctctttactaccacctccaacacatagccaatcttattttaatgtatacccattcattttaaaaagtatttgggatgaactgcattgttcaattatcaacctcaatcaattatccttctaatccattctatgtactgtttcatgattgaattatttgaagtaaggagtctagtttatgtttaaaatttgtttactactaaggtttaattatatccagtattatctggactgattcagtgataaatcagaatgatcagaaaggagcaatggtcttggtacagcacattcttcattacttgattttgttttgttccagccttccatggtctcttgtttcaggcctgaaaaaaataaatagttcatggaaacagtagaaatatttgcataaaacttggtgcttaacactcattaattcttaagttttgtttcacattcgatttattaaggctaacctaataaataagttgtaagttttcttattatacagtaagctaagtacagctaataaggaagacttagaaatttaatttttcttagaagattaaatattggttacaaacttaattcaatacatctcaatttaaatgacaattctttatttatatgactgatttatttaaacatgtcacacacacaaaataaagcataaacatacagagaaaatatatattatcatacttatactagaatttttaatagtagtggcacaattggctgattgtactcctttatttgatttggatttgttttatattttattagagctataataatttttgttttcaccagccaatactcttatcagactgaaaataaaatagaatattttcatggtcagcaataggttaaaaagtttgaatttttgaccatcacttattggtcaggtcattttaattcattgcatcttgtgaaatgattgaaactagaactgttgatccccaagctaatgctatttttcttaacaaaaataattgttatatttatgaatttttaagatcacattttttatattttcatatgggagctaagtgacaggggaagaattttaggaagtcagagggtcaaaaacatatggagggtttctggtaaaggagtgatataatctgatctctgttttaagaaacttatcctggctgatgagtggagaagcaagagatctcagaattacttcacttagaaaagagtaagagttcttagcagaaggccaataggaatgataggctgaaaccacatgcaccctacacagagtgagttggaagaagatttttcaggatttctcttttagaaaaagagaatagaaagatacaaggttgagaaagataaaggacaatttgggggaaaatggtggtgagctaggacagaagtttactgtaattatgcatggaatcttcttttgacattctttgagaattttctataaagagttaaactgttttttaaataaaaactatttaaagtttttattttatttagctttcttgctggtggtctttaatgagactcctgccaattcaagctacatgcattttgaaacctttggtacataactggcatgagattgaatgttttattcctaaataaatattttgtaagataattttagattggtagaaataagttctgttttcactttcataatataaacagaattcttaacatttacaccgtgttattttctgtgactcaattgtttgtaatagaccaggtagtgaatatttagacatttttttgctactgaagtaaatagataataaaatattttaatgataaatttgtttgaagttttgttttaaattttactgtgacagcatcaactggcaagataaaagagcacgaaatccattccgtgttaatcaactgaccaaagaacgttttcaaaagagttatgtcactataaaagctgtgaaagaaaaaaatagaataattttaagtttatagtatgcacactaccaaattatttgaggaatatattacatttgttagaaaagaaacttctaacacatcaaagcatgggaaaacctttctaatttctgttgctctgttttcattctctcctttaatgaaattccatttaccagaagtaagctctgtcaacaacaatgtagtatgactcctttaagtggcataggcaggtatgcttatgtagttacattttacataacttgggccacactgtgtagtggtctgtgacaggctcttttaacagctctttcaggttttccacattagctagtggcacagatatgaccatacatgggtgcaggactagactgcttctcatttcttaacaattgcaaatatttggagtttgtatttctagttagttatttatttgggattttaaagtatgaggcgaagtaggaacctaactttatttggcttaaaaaatagccaacttgacaaatactatttttgaatagtccataatttgcagtgtcatgatttgttatgatttgaaatgtcattttaaaatataatattgatatgatttggatatgtgtccccactcaaatcttatgttgaagtgtaaaccccagtgttggaggaggggcctggtgggaggtgattggatcatggggatggattttccctttgctgttctcattatagtgagcgagttctcatgagatctggttgtttaaaagtttgtagcaccttcctctttactctcttccgcttgctccggtcatttaaaacacgcctgcctcaccttgcaccataattgtaagtttcctgagttctcccagaagcagaagcctgtacagcctgcagaaccatgaggtgattaagcctcttttctttatattacccagtctcaggtagttctttatagcagtgtgagaatgaactaatacaaatatattccagtatatacatgggtctgtttctctatatgccatttgatcaacttactcatttttacacaaaaagcaaataataccttttcaagattgttgctatggctgatatcttagaaagaaaagatctgttcattggtatattttaaaatatttccttgtttattcttacttattcctccatataaatcataggctatacttgttcgttaaaataaaatcccattagtaattgtatcagaatcataatttatttacagattaaattgaggaagataaagttctgtacagcatgcatcatcctactaaagcacatgatggcccacacttactcagttctctttttttaattactgttaggtttattgtgaaagtaatatatcaatatattaatacatattttattatatattatatggttaatataatacatattgtggaaaaatttaaataatatgtgtatagagagcaagagagaaacagataatgttgaatttcaactttttaacttttttaggtttaatgtttttatttttatttttaaatttattatctattttttattatatttatttacttcaagtactgggatacatgtgcagaatgtgcaggtttgttacataggtatacatgttccatggtggtttgctgcacccattaacccatcatctacattaggtatttctcccagtgctgtccctccccttgtcccctactctgctgactagctgtggtgtgtgatgttcccctccctgtgcccatatgttctcattgtttaactcccacttatgggtgaaaacatgtggtatttggttttctattcctgtgttagtttgctgagaatgatggtttccagcttcatccatgttcctgcaaaggacacgaactcattcttttttatggctgcatactattctgtggtgtatatatgccacattttctttatccattctaacattgatgggcatttgggttgcttccaagtctttgctattgtgaacagtgcggcaataaacatacgtgtgcatgtgtctttatagtagaatgatgtataatcctttgggtatataacaagtaatcggattgctgtgtcaaatggtatttctagttctagatccttgaggaatacactgtcttctacaatggttgaactaatttacactctcaccaacatcgtaaaagtgttcctatttctccacatcctctccagtatctgctgtttgctgactttttaagcatcaccattctaactggtgtgagatggtatctcattgtggttttaatttgcatttcactaatgaccggtgatgatgagctttttttcatatgtttgttggctgcataaatgtcttcttttgaaaagcatctgttcatatcattcacccactttatgatggggttgttgtttttttctgtaaatttgtttaagttccttatagcttctggatattagccctttgtcagactgatagattgcaaaatttttctcccattctgtaggttgcctgtttactgtgatgttgtttccttttgctatgcagaagctctttagtttaattagatcccattcatcaattttggcttttgctgcaattgcttttggtgttttagtcatgaagtctttgctcatgcctacatcctgaatggtattgcttaggtattcttctaggatttttaatggttttaggtcttacatttaaatctttaatccattttgagttaatttttgtataaggtgtatggaaggggtacagtttcagttttctgcatatggctagccagttttcccaacattatttattaaatagggaatcgtttccccattgcttttgtcaggtttgtcaaagatcagatggttgttgatgtgtggtgttatttctgaggcctctgttctgttccattggtctatatatctgttttggtagcagtaccttactgttttggttactgtagccttgtagtataatttgaagtcaggtagcgtgatgcttgcttccagctttgttctgcttaggattgtcctggctatacgggctgttttttgattccatataaaatttaaagtagtttttactaattctgtgaagaaagtcaatggtagcttgatgggaataacattgaatctataaattgctttgggcagtatggccattttcacaatattgatgcttcctgtccatgagcacagaatgtttttccatttgtttgtgtcctcttttatttcattgagcagtggtttgtagttctccttgaagaggtccttcacatcgcttgtaagttggattcctaggtattttattctctttgaagcaattgtgaatgggagttcattcatgatttggctctctgtttgtctgttattgttgtataggaatgcttgtgatttttgcacattgattttgtatcctgagactttgacgaagttttttatcagcttaaggagattttgggctgagacaatggggttttttaaatatacaaccatgtcatctgcaaacagagatcatttgccttcctctcttcctatttgaatactctttattttcttttgcctgattgccctggccagaaattccaatactatgttgaataggagtggtgagagagggcatccttgtcttgtgccggttttcaaagggaatgcttccagcttttgtccattcagtatgatattggctgtgggtttgtcataaataggtcttattattttgagatatgttccatcaatacctagtttattgagtgtttttagcataaaggggttttgaattttatcagaggacttttgcatctattgagataataatgtgttttttgtcattctgtttatgtgatggattatgtttactgatttgcatatgttgaaccagccttgcatcccaaagatgcaaagatgaagctgacttgattgtggtggataagccttttttttttttttttttttttttttttttgagatggagtctccctctgttgcccaggctggagtgcagtggtgtgatctcagcttactgcaacctctgcctcccaggttcaagcgattctcctgcatcagcttcgtgagtagctgagattacaggtacatgccaccacgcccagctaatttttgtatttttttagtagagatggggtttcatcatgttggtaagactggtcttgaactcctgaccttgtgattgtggtggataagctttttaatgtgctgctgaattcggtttgccagtattttattgaggaattttgcattgatgttcatcagggatattggcctgaaattttcttttttgtgtgtgtctctgccaggttttggtatgaggatgatgctggcctcataaaatgagttagggatgagtccctctttttctattgtttggaataatttcagaaggaattgtaccacctcctttttgtaactctggtagattttggtggtgaatccatctggtcctgggctttttttggtaggtaggctattactgcctcaatttcagaacttattggtctattcagggattcgatttcttcctggtttagtcttaggagggtgtatgtgtccaggaatttatccatttcttctagattttctagtttatttgtgtagagttgtttatagtattgtgtccgcaactggtgggttcttggtctcactgacttcaagaatgaagccgcgggccctcatggtgagtgttacagttcttaaagatggtgtgtccagagtttgttccttctgatgtttggacgtgttcagagtttcttccttctggtgggttcgtggtctcgatggcctcaagagggaagctgcagacctttgcggtgagtgttacagcttgtaaaggcagtgtggacccaaagagtgagcagcagcaagatttattgcaaaaaatgaaagaacaaaacttccacaatgtggaaggggacccgagcgggttgccactgctggctcgggcagcctgcttttattccctcttctggccccacccacatcctgctgattggcccattttacagagagctgattggtccattttacagagagctgattggtccattttgacagggtgctgaatggtgcatttacaatccctgagctagacacagagtgctgattggtgtatttacaatcctctaactagacttaaaagttctctaagtccccactagattaactagacacagagcactgattggtgcatttacaaaccttgaactagacacagggtgctgattggtgcatttacaaaccttgagctagacacagagtgctgattggtgtgttaacaaacgttgagctagacacagagtgctgattggtgtatttacaatcctttagctcgacataaaagttctccaagtccccgctagattagctagacacagagcactgattggtgcatttacaaacattgagctagacacagagtgctgattggtgtatttacaatcctttagctagacataaaggttctccaagtccccacccaactcaggagcccagctggctttgcctagtgggtcccgcgccagggccacgggtggagctgcctgccagtcccttgctgtgcacctgcactcctcggcccttgggcggtcgatgggactgggtgccacagaacagggggtggcacccgtcgggaaggcttgggctgcatgggagtccatgggggggaaggggaggctcgggcatggcgggctgcaggtcctgagccctgccccacagggaggcggctgaggcccggggagaattcgagcatggcgcgggcggggcagcagtgctgggggacccagcacaccctccacagctgctggcccaggtgctaagcccctcactgccaggggccggtagcaccggccggtggttccaagtgcagggcctgctgagcctgcgcccacctggaactcgcactggcctgcgagcaccgcgcgcagccccagttcccacctgtgcctctccctccacacctccccacaagcagagggacctggctccagccttggctagcccagagaggggcccccacagctcagtggcgggctgaagggctccttgagcatggccagagtggacgctgaggccgaggaggtgccgagagcgagcgagggctgctagcacgttgtcacctctcagtattatctgatggtaatttgtatttctgtgtgatcagtggtgatctcccctttatcattgtttattgtgtctatttgattctttattttcttctttgttagtctgtctagaggtgtatctattttgttaatcttttgaaaaaaaaaaacagctcctggattcattgaatttttgaaggggttttcgtgtcgtatcaccttcagttctactctgatcttagttatttcttggcttctgctagcttttgaatttgtttgctcttgcttctctagttcttttaattgtaatgttagagtgtcaattttagatctttcctgttttctcctgtgggcatttagtgctataaatttccctctaaatactgctttagctgtgtcccagagattctggtacattgtgtctttgttctcattggtttcaaagaacttatttatttctgccttaattttgttattttcccagtagtcattcaggagcaggttgttcagtttccatgtagttgtgtggttttgagtgagtttcttaatcctaagttctaatttgattgctctgttgtatgagaggctatttgtaatgatttccattctttagatttgttgaggagtgttttacttccaattgtgtggtcgattttagaataaatgctatgtggtgctgagaagaatatatattatgttgatctggggtggagagttctgtagatgtctattaggtctgcttgttccaagctgagttcaagtcctgaatattcttttaattttctgtctcattgatctgtctaatattgatagtggggtgttaaagtctcccactattattgtgtgggagtctaagtctctttgtaggtctctaagaacttgctttatgaatctgggtgctcctgtattgggtgcatatatatttaagatagttagctcttcttgttgcattgatccctttaccattatgtaatgcccttctttgtctttttttttttatctttgttggtttaaattctgttttatcagagactaggattgcaacctctgctctttttttgctttccatttgcttggtaaatcttcctccctccctttattttgagcctatgtgagtctttgcatgtgagatgggtctcctgaatacagcacactgatgggtcttgactctttattcaatttgccagtctgtgccttttaattggggcatttagcccatttacatttaaggttaatattattatttgtgaatttgatcagtcattatgaaagtccacacagttgcgttatgagaggagcctgaattctgctgagatgtaggcatagtaaaatgataaccagctattgttctggaggtcacaagatttgtaacttccccaatatacctgtggctaaaacatccctattatataacctgtgattggccttttgagatgtcttttcagactttaacatttctgataaccagctctacctcaacctgcaacttgtgactcaaccggtcctgtggcccgcacctggaggctgactcagggtacaaggatcattattcatacacctatgatttcatccctaatcaatcaatcaacgttctccattccctagcccccttcccaccaaataatccttgaaaaaccctaatttctaagcctctggggaaactgatttgcctaataactgcattagttttagaaagtcagtttagttttggggagggctattatcatccttgctttaatgttaaattataaactaaattcttcccacagtagcttggcctacccccaggattgaccaaggatagcttagaggttagaagcaagatggagtcaactacatcagatttctcttattgtcaattttgcaaaggtggtgtcagctgttagaaatcttcttattcttttcttcatttttaacactttgcatttgtttacacatgatattgcaatcaaacaatcatattgtctggaaaagataatgttttacctcctcctatttttttttctcctaagtcatttcattggctagcactgtaaaaactattagtatttatttgaatggtgacagcatacatccgtttcaattctacttgttaatcttttaaattctcttttaaaaattgttaatatatcatacaactagagagatatttgcgaaatcaaagagaaatagcagtttgttaaataaatatgatgtacagtttattttgcttattcaaatccagattttcccacctactaattgggatcacttggtcacataagttataaaggggggtaattgtagcttcgtgagagatgaagtagcttgcccaaaggggactcagtgacaaaatattaaagcttgatttaaaccctggctctaattattgtgctatgataaaggagctctttagcacattggtgctgtattactattgcatgtatttaaatttaatataattacaaaatagagtttatatcttcgaaggaaaaagctttgatcaatttgataatgatttattgtttttgttgttacatcaatcttttgttcatattaataggttagagataaatttttagtattttttaatgcagagatatatttgacatttatttgcctttctttatgtaaacattattgctatcagagctaaggatactctgaaagtaatattgctaatgaaaccttgttgtttctttgcttttttaaacattttattttgttttagattcgggaggtcaatgtgcatgtttattacataggtatgttgcctactggtggaggttgggcttctagtatacctattatcaaaatagtgaacattgtaccccattggtaatttttacatactgttaattggtatattatttttctagggctgccatacaaattgctacaaactcagtggtttaaaacaacagacatttactctctcacaggtctggaggccagagtctaaaatcaaggtgtcagtgggaccacatcgtctgaacgttcaaagggagaatgcttgtagtgcatggcaggagagccccaaatcggagctttaccctgtaagggttcttgattttgcccaggaaagaattcaagggcaagccagaggtagaagaaaacagacttattgaagaggcagtgttacagctctggagatgttagagctccatgactgcttctgcagagcagggctgcctcatagggagaaaatagcagcttagggcagttttgcagtcatatttgcacacacccctgcaccctttttttttttttttttgagacggagtctctgttgctcaggctggtgcgcagtggcgtgatcttggctcactgcaacctccgcctcccaggttcaagccattctcctgcctcagcctcctgagtagctgggattacaggcatgtgccaccatgcttggctaatttttgtatttttagtattttgtatttttgtatttttatattttagtagaggtttcaccatgttggccaggctgctctcaagcttctgacctcaagtgatctgcccgccttggcctcccaaatttccgggattataggcgtgagccaacgcgcccggcctatacccacttttaattgcatgcagattcaggggtggttcatgcagacatttctaggcaagggatagtatcattgggtcattgccatggaaagggtcagggcagtaactcccaggtgttgccatggcaacagtaaattgacatagcacactggtgggcttttctgattgaaagctgcttctgtgctggccctgttttagctagtcctcaatctggttcagtgtccaagccccatctctggagtccagtctggcttcctacttcacttgctagtcttttccagcttctggtggctccaggctttcttggcttgtggcagcataactacaatctttccctcagtttcccaggcccttctctcctttgtgtctctatatcctttcctgtgtcttacaaggatactcttattggctttatggcccaacctgattcaatatgatttcatcaagattcttaccttaataaaaccttcacagaccatatttccaaaataggtcacatgagcttctaaatggacattaatttttttggggggagggtattattcagattactacaattgctagaatgagctaggaaaaagtagagcgttaataggtctatttcgtcaaagtagtaacattatagataatttaatatttatttcttttaatcctcaaaattaatatttctgaaggaaaaaggaactgaaagtggtaatgccattaccaaagttatgtgttccctcttcaatcataacatacaaataataagcaatcagcccactgcctcagacatgatgttcaaaagagttaaatccctttccaagtgaataccttattctccatttaagcagacattcctcttgcatacctgtaatttgtcttatgtttgagtagctaatgatcttttaaagaaatttaaacatgaaatttctctgagaattactctgtgatctcaaatcattaacttcttataaccctggttttctcattgtaaaatggggacaataaaattatctcacaggagtattttgatgaccaaatgagataaaatatatgacactttatggaaagcactataaaatcatagtggatatgtcagtattctcatcagtaaataaaatacaatttgaaaagttcatttatttaacttttaatattaaaaggtaatcattcagttttcgtttttttcctgttaacatgctgtcggattttccatatctttctgtggcttagcaaattggtgatgttatttttatttcagtttaaataattagaatgactaatttgcagactggtaatgagtaggaaaaaaattatacctaattaatttactattgaaattaattttttgctcttgcttattttttccttccttgtatagtaatattacttttatattatccccattttccaaataagagacttgatgaaatttctcttgggcaacacatgataattatgcaaacatgttgtttgtcaaattgaattcctcaaaaggcactagaaaaattgatgattccatggcaaagtttgtgatactcttgagtacatatattgtgaaagaagacacatttagaacttcactcaagaggtatttgaatcacatcacttgggaaactgatactcatcattaattaactgggttagacctgaagggctattaaagtaacagattcaggggtaacaaagagagagagagagagaaagagagacatatggggaatcaggaagtaggtacacttgaaaacaaacaaaaaaaataaggccatggcaggtcagcacgcatgataaagaaaagactgtttatatgtgtacctgtacctgtattatatcttctctctctctctaaatatatgtacaaacatacacacatacacacacacacaccacacatacctatacagatgcacatacatatttatttctatataggctcagaattactattccgagttgttaatactcattgccaacaaatgctgcctccatggaactattttgtttttattgtgagtaaaatctcagagatactaaaacatgaatgtgaagaaattgatacatgagcaggacaaaattttttttaaggacaaaatttaaatgtaaaataaaatacatttcctccactaatcagaaggggaattagaattttatgctaatcttttaatacaaataatttattgcagcatgtattagggttcttcagagaagcagaaccaataggagatctcaaatcaagatgaagatttattacaaggaattggctctcatgattatggagtcccaagatctgcagtcaagtcccaagatctgcagtcagcaaattagagacccaggagagtcattgtatagttcgcgtctacacattgaaggcctgagagccaggggagctgctagcatagttccagtccaaaagctggcaggctcaacacccaagaggagctcatgtttcagttcaagtccaagggcagggaaagattgatccccagtttaaggcagtcagggaataggagttccctcttattctcagaaggtcagttttctttcccattcagggcttcaactgattggatgagtcccccacccccgccatcttagctcaatctgctttactcagtctactgattcaaatgttcatcttgttgagaaacaccctcacagacacactgagaataatgtttaaccaaatgtatgcataccctccggcctagtatagttgacagctaaaattaaccatcctggaacactaagcttttctattgcccatattgatgcctcagagatatttattttaaaaagatagtatggtacatggatattagagaatagaggttttggttggatttgagcaagtggggagaggatggctacttgggagaacaaaggaaacctgagtttcaagcagaattccaagtcaaacatttgataggtagtgggctgatgggggaagcaagaagggcaaaggaaaccctatgtctattctgcagttttgtacttccttactctccactttagtattcaaaagattttattagccacctgacttatgaaggcattgtactaaagagagatatccttaggaaccttccaaattcagtaaagaaactctgacatgcttatgatcacaataccaggtagaagataatatctgccattaaaatgttttatttcatttgctgattttagaggtgagcaagatgagctttgcctgtcagaaaattggaaggattcaagcatccaaatccagttatttgaactggattatcaagaatagacagaattggctgggcgcagtggcttacgcctgtaatccgagcactttgggaggctgaggcgggcggatcaccacgtcaggagattgagaccatcctggctaacacggtgaaaccccatcttcactaaaaaaacacacacacaaaattagccaggtgtggtggcgggcaattgtagtcccagctacttgggaggctgaggcgggagactggcgtgaacccggcaggcagagcttgcagtgagccgagatcgtgccactgcactccagccagggcaacagagcgagactccatctcaaaaaaaaaaaaaaaaaagacagaatttgggccctgaaaacatatgagacaaagattgggaagagaaaaacaaaagaagagcagcaaggaaatggtatacgggaagaaagtagcctctttggctctaatgtgtaagctaagtgaaagtagaaagcggatacatgaggctaaaaatctagatcaagaaatgattggaaagactttgaatattaaaatagagcagtttgggtttcattctatagcaccctgacaaccattgaaaagttttgggcaggagagccatgtgtatattagggaatttaccctatgcaagttaggttgtgataaattagcatatggaagtcgaagaaaaagttaaaattcaaatttagtagctatttgcagatttggaaaaaataaggcatagattcacttcatcatttgtcaagttaccagctgagaaaagtggtattagagactgattttgaaacttgtgagaaggagctgaagtttcagcaagaaacgcagccactgtatacaagctcaggtcttttgtagggcgagagtaatagtaacaaatacttcaatagcactttagccatgtgtctaaatatattcacttatttaatttctattacaactctatgaaatgagtagtactgcttactccgtattactgataagaaaataaaggcaaaaaaagaaattttcttaaagtcatgctgtaagtcagtcatgtaatacgtctgtgactgtgacacaggaaatctagatctagagtttctgtcctaaacctctctccgtagttgcctctctatagctttgtttcagatatgtttacaaaatttggataggcctttggatgtgtgttaaatgtacaaatttatttagaggtaatgggatattaaaataaaggtaattaaagtgtggctacatacaacacacatacaacatatgtaactgtatactgatgtgtttacattgaaatcaaggattcttagactctgggtagaggatggtcaaaaacatttgataatccagtcatggtgcttattcaataggtcatgaataaagtggcagtgattttttttaagccatgaaaagaaacctaaatcctcagtgtaatctttggaggggttggcagggagagggggtggattatgaactttactgaagtttccctctatttctaaatatttatctttctcttcaatattctcattagcttaaatattctctcactgccttgcttctgtagaggactgtgcacagctgctagggatgctggcattgaagcactaagagaacagtccacatctgggatggccttggtttaagcaagaatcctgtctaacatcatgttcccttcccagggtagccagcatccaattactgctcaactagtactagaaaggcctggccttatcaccccaactcaggacaactcagatggctcattccagtttcagaattcccaagagggttggctgagtcttctgttgcaactcttttgcaactcagattttccctatgcccagtcatgcttcctttttttcccttccataggtattgatccccagagcactccttaataaacctatagtgaactaatttcattctcaaggtcagctttttgtagaacgcatcctgagatgagacaacttcctagaaagttccacaataggttacagatccactgtctatacctttctttcactcagctcctctcaccttcactatagttcctattgtgtttttttcttggacagctccttgtttttcttacataaatcaactttccttttcttggctgtgtactgttctttctctcctttcttcctaatcagcataaaaaaggatcaaaatctctctctctttctctctctctctctctctgtctctctttctctgtgtgtgtgtctctctctctctgtctcacctttgaaggtatgggaaggggacagattgtgaatacttatattttactattttgttcttatcctcttatcttacccttatggacaattaccgtgtaccagaactaaatccttccaagaacaattaggtggactatgttattgttcatccattatggatgagggaatgtatgtttaacataatttaaacaaattgcttgggattcaacagctagtgttttgttgagggaaagtcacttcttctggattccagagcagcaaaccctatcattatgctacaaggtaagcttggataccctcagttttgtcttggtctgagcttgcacatgccattttcaatgtctgcctgttatccagttagcagtgtatcctttaatggcctgcttccatgaggacacccgtccctttctcaaatatcttttccaaagaaggcgggaactaaaaggaggtagggagaactaaaaggtaaaggagggaactaaaaggagttttcaaagttttctgagaaattgagtttgtatgtatctttggtgtgtgtgttatcaatatgtagtggatctaaaactatttaatagcaacatctaagcaaggccttcctggttggcgagtgaatacatttacactggtagctcagatggatactatttgaaaatgaaagatttggtcaattatatagcagaaactgttgagtaatgtgggaagttttatgggcaacacacagcatgtaagtgtatttttccacatcaaagccagaaaggtctgtaaatgcctgtttttccaaagtgtaactataggagatattttgtaatgagtattttgtagacaacgtgcattggctttgtttgccaaggagcatactaaatagtatctctaaaaattctctcactgtgaagcgtgtacagtattccctatgtacagggaaagcacaccacaccaccaaacacaaacacacacacattctattaattaaacctttgtatttgagtcagaaagtctcttaccttttaaagatgatttgtgaattactgaacacaatgatattaaaaattctatgcttagggtatccagacaaacacaaagataaaatattaatacatggataaacatgtatatggaaaaaaaaaacagagccatgatgacaaaagaaaatgtaaatttagtgcaaggacagaagcgctatgaaagtcagttttcattatatcacaattatagtggtctctttcataagcttttttaacataatagtacttagatcattctttagaagaaacttttcttcatgttttaacttttttacaaaaaaaaatgagttagaaagttgaccttaggttttggtgtgaaataaatatattgtatcatcaaaattaaccatgccaggaggatgtagctgactctacaattaccatcttggtccttagcattttacatcttggtccttagtaagcagccttccttagggacatagcacagacaaggactgtttctgtttagttgaattatccctgaactctatttaaggcggcatcaaatattcctaaaatttgtagcctctcttacctcagttacctggagacttaaagatattaatgctactttttttgatccttggattgctctttaaacttatttttcatgggtccttttcaaaaagagagcaattatttaatgttccattgtgcaatagggctttttatttgttgcatgttttttttcttgtgataatgatatcctgcagtgtttcaaaaactgggatttatagattgtgggaaattcacaggtgttttctccagggggtctacatgtcttgaatgttaagaaacatatgttgtactgcatgggccaaaaatttgaaaagttggtcatactttcattttgataatctgtttaacatccctatggtgtccattttaattaaatcttacatggaaatactatactatatagaactgtattcaataagtaaaagaaaatatatattattgaatctattctttgtcatttgcagccctgtctctttgatgcaagttttgaaatgacaagagagttttctaacagtggtataaaatgagattattataatggtcaattaaaatgagaaatgatagaacatgttaaatcatatagaaatatttggtattattccttgaaattgcaaacagattattatacatgtatatgtatgtataatgcaaatatgaacatatataatatattaacattatatacaaatatttaatatttgttaatatttaataaatataaataatatttaagatatatttacatatgtatagaaagagatagaaagagagagagatacagaaagatacctaattatttgatctgtcattcattctaccaggtttacatctgcttgtgactgagaaagtgtttttcctggatggaaaaactgtaaattattaacagtaattaagataaattataataattttagttttgcatttttacaaggcagacattagacattggagaataactgtgggtagaagtccaggagtcacattttctgtaaccagtgagcacatgacactgcgaagggaacacttttctaatatcccccataaaaaagaattcacagtaagatacacgcatgttaagtgccatctaaagggacttaattactgaaacactaaaaggccaggaaaatgatgcattcacaattcactgtatagcaagagataaatttaagttgtactgagaaaaaaattttttacttggatggttcttcaaaaaattatcatcactttgagaagaggtattgagccagtgccagaagctgaatatggtcactcttgtaggattttgttatttttggatataagggtgtttttatttctaaaacattaaaaacattttagtttcttttgtgggagaatgaaaaaattatctcaaaatttgcagtttcttccataagattttgagtctacttgctttagcaaatggaatgctagcaaaataagtgaaggagatgtttgccacatctttgatcattattgatgcttttggaaaccagctgtcatttgaagaagttgagattagctgagtatctagggaaccattattctggcaggtgactgaggctgattgtttcaggatggcctcacacacgtctggctgttcaagtggcaaacatccatcatgaacaaacattggtcatgtgtgtgaggccatcccaaaacaatcagcctttaattacctgccaggcaactgaagctgcacacataaactcagagcataccaatggaagaaccacccatctgagcccaaaacaaaccaacaatccacagaatcatcatttattaaagtaattatttattctactaaattttggagtggtttattacataataatggatatggcataccctctctatgttgacactagttctcactattccattccagttgttcatacaacagaacttttcatacatgtatattatctacctggctactgaaagcacttcagttctgggcctcactgaaaatctattctttgaagaaagaagcattgaataaatataatgtgttcatataccagaagtacaaatatgaataaaacttagtaatccccctcaaggaaccactgtctaatgggaaagatagtcatgtacacagtttgcatggagccagcataggataactaagagtatgataaaggcaatcattccagattacaaatgtcagattttcatttgtgatttcagcaggctgttccatcttttttatggtgctctgtagtttttatattccaagaatgccaagacacacatacatgtattcacacaattatttttagagactttggatttttctagtttagataggaaccccagccccactggcattcgtgctagtgatatcactttgtagccatatgatctctagtgtagttagcttccctaagtcaatgcctgaatgattgctactgtgcccactgcaataaccacaaccattcccacaatgctgtcctctattgtgaagtagagaaaaactccagaggaaattcaatcaggcccccaaatgaagcacaagagagcattctctttaattttcttttacagggctgccaaggcccaaatctctggaagttctaaggaaataaaggtacactcagaccacctgcttctgctgataacagtgcagagttggtagcctggtggcatcagccactgctagtttgacagtcatgccaggcaggcaggtgcaagctgcagaagacataacttgccagatatcacacttacctgtgttgaaacactgtaattttcacagaccaagtcattgattctttaaattttctcatgctttactaacaaacatttgccacagtttccactgtgtaattctcttatcaatttttccagccatgttggtttcttgtgcataagtggacgtctttctttccttctagcttttaacagtaaaatggttgtgttacagttcatttaaatctcattctcttatatctatctctatgtctgtctttataccacacacacacacacacacacacacacacacacacacacacacacctacctctatatatggatagtacccaagaaaaaatttactttagttttttaacacattacttttaatgaatatattccattaaaagatgggtaaacattagctctccatcttcctctcagagctaggaaaagatgacttttgattcttggctctttatttagtgatatagatcccttctgcctgttgagtacactcacagcccttcctattcattcctttactgtttcaattgtggtagaccgtggccagacctgatttatttaggcctatctaagccttgcaatagaaaactcaactagctgcatatgtcgactaattaacattttgcatagctacatacatatcacataagctatgacatccagatgttatataaattgttgccaatataccagtatggcactggtagtgtcacaagaaattaaactcagaacgtataagtagattcaagtgatatggcttattaaaggtagcttgataaatatgtaggcaattatattaaagttttggaacataaaaaccttgctgtaacctataaagacctcaccccaaacaaaataccataactaccatggccaatgtgaagaaattggggagatctcttctgatttttttctgggatactagcatcaattttggtaaaagaaatcagaagtacaaaatatgagtaaagtgtttttgatgctaaatttaaagaattcagcagtggaagtggatgctatagaagctttagttgttttctaagataattgtataattagtagcagtctttgttagggggtgcagggagggaaggagcctattccagattactgagagaaggttcgtattcttaatattgccctgtgtttatttaaccaatctatttttttgacatttggaatgcttcagttttaaattattatacataaaactattaaaactataggaaacctcttacagcataaatctttgagccacatctgataatttccttgaaataaattcatagaagtggaattactgggtcaaaaataatgagctatttctaactcttttaacatattgctatgttttttaaatgattatatgaggttgcctgttttacagcctaattgccaactttgaatctaattgttggtaagtgttgtttgcctttttaaaataagaataccattttctgttttataaatgttttattttcttatttgacttctagctgactgagggcagaaaccatggtatgtgctgtgcacagtactgtttttgtctccctcagcactgagcatgtaatgggctcaacaaatacttttcgaataatatattaataccaattacttttactcatatatagtaggtaattaactgatttagatatcagctaatgaagatttgatatttatcattagtttatatattaggttttcaaggaagttcaagaaattgtgaatatgtttctgtagtgcttaggccaactgtttctcaaaggaattgttaagacaatgttattcccttcatttggtcgagttagggtttccatttcctttagtttcagttcctcaaattacgttcctcagacatgtttacaattttaaaggcacctctttagtcaatggggaatctgaacaccttatccttagtgacactaaagacaagtaattggccatgttaagatgtggttgttggcttagcagattctcataccagctgttatgtcttgataattattccaaaaatgaattttagtttaggttaaagaacatggcactcattcaggtttaattaagtctttttagaaaaatatgctgtgccattcaaacagcctggtcttatattaagagttattttaatcatttactgtacttgtggccatattgtcctcataactacaaatatttaaaaatagttgatgaaataatttcaggtaatttctcacccattattactttgatcaaggtgatttcatttttcagtttaaattattttatatttacaaacgccatatgttataaacttttaatttagttctgtggtgaaatgtgggtgcatatgtgcatgtgggtatacatacatatatgataggggcaggaggcagacaaattcctaggtagattggggcgggtccctggtgaaactgaaccttcaaaccaaagaacctgaagcccgaaaaccacgctctcagttccaggtgaaatccaccacctggagtgagatttttgcctttccaccaattaaatggtgctttttccaggccctcccattgatcaatcaggatgcacttccttcattctgagtccataaacacctgggactcagctacacatcaggactccgcatctgcaggtgggagccacccacttgggtctcctccctactaagagctgttttgctgcttaataaaactcttctccatcttgctcactctccagttgtccatttaacctcattcttcccggatgtgagacaagaagtcagggctcactgagtggcaggcacggaaagggctgtaacatgtttttggctggcttgccaagctgtgaactgtgacacactcctgtttgccagacagcaggagtgaagagtggcagcccttctcaggatttcctgagccagagctgtaacactatagcccccctgcccaccgctggcatcgagtggcttccccatgtgatgggaagtggcagcggggccaggccagcctggaaactaagccggagcaaggcagcaggactgaatgagctgaaacatgccactccacccccacttgctgagctgctggcaacaggattgagagagttgtagcgtgcacccccccaccccttggagctctgcagttgctgacatctctgagttttcaggtgatgtcatgttcctcatccacactccagcacctgcattggaagctgtttatggtatgcctggttcagccacagcctcgcatggagccagcacctgtgatggcacctggagctgtccaccccaccacagcagccagctcacttggctatgcacagtggctggacaacacactcacttgctcacacacccttcatcactccatgcctggcttgcgctcggtgggcataggatccaagtcagtagcatgagccaagcacagcctgctgagccaagtgggtggaatgagcccagtgggtgtgaatgaaactcaagcagaggtgccaccggtcacaaaggtttctggctggcaaagtgacacctaaaggatcctgtgacatttctggggcctcatctgggatctgcagaagactgaataaaagtgaacttgctgctttctgtccttcttttcagagtcccgaaagtccacaataaccagaatgaaagaaaaacatcggcctctgttggccagataacactgactagcgtggctgctggactgaagacagggaggacaggcttgcccaggaggacactgttaatcccccatcactctcaggtgttgggaatgttggcttttttccaatccagtttccattcacggatgtctagccatagcgtcagattggagtaaggtcctggggcaactgatggcatctagctgaggccacacgttggtgttgcctgaaagccccaagaccagctgcagtctccaacagcccagtagggtgtgagcgctaggacttgcattctttcctgtcacattatctttctttcgtggctgtcatggctcctatctttttttaatatacaatgttaagggtgttgttgcaaaccagagagatagtatagtcatcaggagtgtaatccagaacagtgtggtttctatctattcttagaagcaagaaggatgtaatgattgaaagctttctttcctctcttgaagaaatttattagcatggggcaagaggctacttcccccaggcacccctctgtcccctgaatttaagttttttttgtttttatttttgttttccaccatggcaggagccaacataatcctgaaaataccaggattttttccatgcaaagattgatttttttttcctttcgggaggcatcttattaggccaggtccccaattcctgagactccctctttctcccttatttgaggagaacctggttccacagcttcatgttagcattctgcttatgatagggaagcagtggagaagctgccctgatggttgctgactgcaattttgtgagggcgacatgggactaatttaatgggtccatacaccctcctgaggcacctttttgtcctaaatttgattccaagctttggtttgaagccctaaaaaggaaaactagatctgaggcacccaaaggtagttacagtggaagaccaaggcacaatgcaggtgaatatgactatccctgccaattaggtcttcccacttcatgggtggagaactcgctcacatccatggcatagacaaggactagggaacccacaggttaccaacagtgtgaggatagggcagcataggtaagtgagaatatccctacccactaggcctccctgctatatgggtggagcctttcgtggatgccaggacttgggaaggaaaggaaagaaaataggggacctttttttctcttctcacaaaccctgggttttcactggaagagagaggaactaagggatgccttttcccctctcttccagttgggttaccaatcattttcagcctttactcctcctgaatgcatcctgaatcactggaacttctctgaccctcagactctggagaaaaagtgcatcatattcctttgctcaaaggcatggctggattatgttctgcagggaggagaagcttggcctcaggaaggaagcattaattttaataccatcctgcagctggaccttttctgtaaacatgagggcaaatggtccaaggttccatacttgctgactttctttgccttgcagggtaatccagacctttgctgatgttattgaattgattcagtcctagcagccatcccaggagaggctgcaaagagcaatcccaagggactagggaagcaaaccctagaggtaccttcagtaggggagtcaacccctccagtcctgccccttctggtccaccccatcctccatatccagattctttctcaagcttgccccatcctagaaatcttcattgtaggcaggtcccagtctcactcctgcccctacaacagatgccaggtgaatccggccccattaggattcaggttccgttttctctataggacttaaggcaaatcaaggggaatcttttgcaagtttgccgacgactctgacaggtatacagtggctttccagaatttaacccaagtatttgaactctcctggaaggatgttatgttacttttgaatcaaaccctgactactgctgaaaagcaggccgccctgcaagtggtagagaattttggggataagctttgtatcttatatagtgccagggaagaggatgagcctcatccaattggaagaatagaagtatcactggaggaccctaaatgagaccccaatgataaaatgagggaatgaaaaatgaagcactttcaggtgtacatattggagggcttttgaagcactagaactaagcctcccagttactccaaactgtctttgatagaccatggattagattaaaattccactgccttcctggaaaggctaagaggagcattaggacagcaaacctctttatctcttgattcagtcaagagacaactaatcctaaaggatacatttattactcaggcagcccctgatatcagtaggaagctgtagaaacaggcatggggccagatagtaccttagagaacctgttcaaagtggccaccttggtcttttacaatagggactgggaagaatcctgagagaggagacaccacaaaaaggcagagggtctaatggccaccttgcaggctcacaaaccccagaatccctgcgatgcacctgttaactgctacatatatggcaagccaggacacattaggaaggactgcccaagcaacatgaggaagccacctcgaccatgtccaatttatgatgtggaccactggagggtggactctccctggagatgcagatcactgggtccagagccagtcttccaaatggtccagcaggactgatgggtcatggggtccctctcaacagctcccatggttcagactgccattaccctccaggagccctggtgattcaggaacttgaagggaggaaggtggacctcctcctggacaccagagagggcctttcagttctccgctgaaatccatcccccctcttctcttggcatgaccacgaggggtgtctacagaaagtctttaaaccgatatttttccaaacccttagttgtaactggggagatgtcttgtttactgtcacctttttaatcatgcctgaaagcccaactcatcagccagacagggatattgtggctggtatgggaaccaccttcctgatggttccaagacagactgtttgcatctttctagtggagactgatattaacccagaggtttgggcaactaaagggaaaactggctgagccacaaccaccacactggtccagatccaccttaagtatcctacctccttccctaaccaagacaatatccactacaaccagaagttaggaaagggatagaagccatcattgataacttgaagatgcagggcctcctcaaaccctgcagcagcccttgtaatacccctctattggggttacaaaagcaacagggaatggagactggtccaggtcctctgcctcattaatgaggctgtggttccaattgatccagtggttcccaatccctatgcctcaaatatctgggggactaaatggttcacagtcctggacctaaaggttgcctttttgtacataccattgcaccctgactcctattatttgtttgcatttgaagatccctccaacaagaccacccagctaacctggatagtgttacctcagacagcccccacctgtttgggcaggggttgtcaaaagatctctctgagttcgtttatcatcaggttaaagttttataatacgtagatgacagtttcccttctgccccaactgaggaaatctctcaggagcacagtagggtccttcttaattttctggctaacagagaatataaggtctcaaaatttaaggctcagaatgagcacatgctgttggaaaaaatggtgttgatcgacttgcttaatgcaaggttgccacaaacctccaattggcatttaaaaaaaaaacatatctatgatgcacaataaagagaggcacaataaaacaaggtatgtctgtatcatagactttaacttttgttttatttaattaatattttcaaagaataagttatttagacgttggtcttctcatttccttaagagaggcaatgtctgggattaacctccaagtcatataaattcttatgtaaatggattgctagaaattatgaatttgggcagccatctggtttcaaatatgtatgagcttagaagggagtagtgttttatttttcattgcacattttctcacaaaaggtggcctcttctaaatataacattaaaaagcaaagaaagaaaggctaacctttcattgcaacttctctagagttgaagtgctttcctctgatctatgtagaaaaggcaagacccttcaaagcatctatacttgttaaggatcaaagagaatacttctaaatgaaaaggtggagagataaaaatgaaagttatcagtggaactctgtcctagtcttttagtatcctagaatcactattctttttatgataatttctaatgcttggggatcttcaaaaacaaaagcacctatcttttgaagtcaggtctagagatgacaggccaaagtgctgtataaggaactactgctttggggaaatttgaatccaaccaactgggaattataatctttagaacagaatgtagaattgcactcacacaaagaccagaaaagagaaaaacttcagcccaaaacagacaaaggaaaaaggccaaaaaaaaaaaaaaaaaggcattctcaccataaagattagatggaaaaaaattcaacaaaacagagtgaagggccatgtgcggtagctcacacctgtaatcccagcactttgggaggccgaggaggacggatcacgaggtcaggagttcaagaccagcctggccaatatggtgaaaccctgtctctactaaaaatacaaaacaattagctgggtgtggtggcactttcctatagtcccagctactcggaaggctgaggcagaagaatcacttgaaccgggggggcggaggttgcagtgagctgagatggtgccactgcactccagcctgggcgacagagcgagactctgtctcaaaaacaaaaaacattaaagtatggagaagtgatttctgtaatacaagggttgcccccagaataattgtttcaggagatctttcccaccatccatctatactaaatgattggcatcataaaaattttgtccttcactaaacctcaaacatgaattcctaaagaattggattatgtgcccagtcacagtggttatcctggatactcaaacagaaaagaagcagattagagacttgtcaattcaatgtttcagcaaagagtaaagaagaagatgaagaaaagaaaatattagtttttgcaactacatccaggacaaagctgtgctttcaactctgtgcatagaaaaattccatcctatagcttctcggccttttggctcagatcaagtgtagaaagactgcatccacgagatattcagagttggtacagggactgccctagacagcggtggagctaatatccccttatcataagctcctcatattccatacagccccatactccaaagccacagatttttgtgggttgaaaaacccaaggcaagtctcctaaaattaagattgcttgtccccaagaaggcaagaagaattcttatttgctctgagaaaatacactttctaacaccactacaagcaatataaacagacagctgagagtcaacagatgttgtgttaaattcagacctcaaaatggaggcaacaaaattaacaaaactaaatcatgagaaaacagagttaattagggataaatgaatttaatataataattacagttgtaaagataagaaaggataatatattttgaaaaatatacaagtttaaaacctcaatattcttaagatatgttaaaacatatattattatgtgtatgtacctttgtggaaaacagaatagacacaactgaagatagtaagctagaatactgagaaagaaaaatttcccagaaatcacagaaataaatgaataaaagtgtatgtaggattatgtgtgtgtgcatgtgcctgtgtatatatatttatatatagatatataatatgtataaattatatgctatatgtatatatataaaatatatataaatatatactatatattttatttaatatttaatttaaatatctatatacacacacatgcacatacgcatgcatactctctctatatatataacaacatatatatacgcatacacagcctggaacccctgcaagatggctgctattattctagatgttatttttctttctcagtcttctagcttactacattcagctgtgtctactctgttttcaacataggtacacatacataatatatgttttcacatatattaagactattgagtgtgttttttaacgtgaatatgttccaaaatatattattctttcttatctttataactataataatccagaataataatagccttcttgcaggcattacaggctccaaccaaaagaacagggacaagtaagtggaatcaaacaatcaaataaatgagtctaaagtttgaaatgaacagctgagaaccgaacaaagtgaataaaaacagattcaaactcagatatatgttagtgacatttaagaactgcatagataagatagataagatagaattgttaatattttcaaagaacaaagtatgtcacatgccaaaaaaaaaaaaagagacatcaaacttcagcttgagcagaaaaatatttaaaggcaatcaagcaaagcctccaaagtgctgagggaaaaatgatgttaaattgagaactttgtagctaatcaaatgagcattcagttatgagggcaaaataaaatttattttggatatgcaagagctcaaagtctattagggataaagtctttctgaaaaaaatgtagcttactataccaaagctaatataatataaaccaaaatataagaaaacaagctgaggccggacgtggtggctcatgcctgtaatcccagtactttgggaggccaaggagggcagatcacctgagctcaggaatttgagagcagcctggctaaagtggtgaaaccccatctctactaaaaatacaaaaattagcggggcgtggtggtgggcacctgtaatcccagctactttggaggctgaagcagagaatcacttgaacccaggaggcagaggttgtagtgagccaagattgcaccactgcactccagcctgggcaacaagagtgaaactctgtctcaaaaaaaaaaaaaaaaaaaagagagagaaagaaaaaaaacaagttgagatacagtctatgataatatcaattaaaattatgcataatttctaaataaattttatacataaggtaatagcagctagaatattttatttcagaaagaggatagggaaagggaaataatgctaatttaaagctggatcaattcaacaaagcttatgaaaataaaaccaaatcaagaatgcaataaaggaagtcaatatggtagaattcagtaatcataaggactgtgggttaatacctattgaaatacagagactttagggctattttacaatctgaacatacatgaaatgattgcaaaaaatacaaataatatagaaaagtctgcaaataaagggagagagacagatatacttgaccgaggatattttgaaaaaaccaaatgcgatatcactaccaacaaatgcagaaattcgaaattaatatgtttagtggacagagtattattaaaaattaatcaaaatgaataatttaagaagatatgatgaacaggattataaggtatgaaacagcatcattctgaagcaaatagagaaggaattctgcaagttattcaaagagaagctggcaaatacgccaactatttgtggaaatttcaacatccttttgttaagaataagcagatcaaatttttggaaaaaatttggggaacatgaataattatctgtctaaacattgtgtgtatatattttgtatgtgtgtgaatatgtgtgcatacatatatacatattcatgtatatataataatgtaaatatgcaaaagcaaaaagtctaaattgttgtttaaatagccatcagtgttgtaaatatgaattccatttaaggagctaaagaacaatctcaaattttccaaagtaagaatcttttaaaaactatttgtcccccaggcaaaaatgaatttgataattaacaagaaaattgccaaaactaagtattacttcacatcctgctatacagtagaaagttctaataattagtagattagtagttcttagttgcagccacccttcatacacctgttcttagactaattgggaaccagaccacatgacctctaagtgcctttaaccttaaattaatttaagtctctaataatcttgggttaaagtttcagtatattaggaaacattcttttttgtttctttctcttcaccacaaaggctttggtaaaaacaagtgggaaataatttatttttctaggctaaactttaatttgattattttaataccaatgacactaaatttcacaagattaataaaacacatttgaggctgattaaatagtcacttctaatcataatcactccttaacttgcttaaaaattattatcttagaggtacatttctatctctaatagaaatattaaactacaagcaagaataatttctgagccatgggattcttctctgaaggcttctgcacatgttattattctcttttcttgttcaattaacacacacacacacacacacacacacattcctagcaaaatattttggttaaaagccatgtttcttacccaaaaggatataaaaatttcaaatactaattgaaaaataaagtggcttaaatgagatatgcagactgccaatttatgttttctttagaaatctataaaagaaaggaaagaaaaaagcagcagaattttaaaaaggaaagacaaaacaaaaagacaatcctaacaaagaaaaacaaacaaaagaaatatttatataaactgaaaaaagcattaaaatatcagacatcttgatttctggctctttggggatccagttaataaacaaaagcatcagttgggccccgaccaaattcaagacagtatacctgataacagaaagtatctgaaggaaaataagacatctaacaaagcagggaaaattttatgcaggcagaatgatatgacaaattgaaaataaatataaaatcaaaacatgtggctaggcgcggtggctcacgcccgtaatctcagcactttgggaggccaaggtgggcggatcacttgaggtcaggagttcgagaccagcctggccaatatggtgagatcctgtctgtactgaaaatacaaaaaattagccaggcgtggtggcgtgcgtctgtaattccagttatttgggaggctgaggtgggggaattgcttgaacctggaggcgaaggttgcagtgagccgaaatagcgccactgcactccagcctgggtgacagagtaagactctgtctgaaaaaaaaaaaaaaaaaaaaaaaatcaaaacctgaaacttaattcaagtattaggaagcaatctatttaatcattttatttttcacataagtgccatggagtaaactgtcgctgatttaggatgtttacaatagcccatggtttatgatgcttgtctacggaaatacttagatgaagaccaaagtacaaatttccgctgccttttgctatgcatttgcacttcatggttttgcacactttctaagtctcctaaaaatccatggtccaaaagaaataagggccttctcacatctgactaaaccttgtctatatcacttttaagaatacaaatttcaggaaataatgtgaagtggtgtcagcaggatggaggaataggaggtcgtagactgcactactataaccaaactcgggttcagctgctcttcactcagaagccaaaactccagaaacaagggatggtgtgaggaaaagcaggtttattctggagctaacaacttaaggagatgttgaacttgcattgtaaagaccatctcccctttttctggctggccaaaggagttttaaaaggaaggggcttgggaaactgtgcagaagttagctaagtgcagatgagcatgtcctgttccaatgattatcttgagtaacaggccatttggtagtctggctggcatcagctagattgcagcaggattgaacattgaatgctcagcttttttccaggggtgggtatttcacagccttgattttatctcaaggttagttcttggagttcttaagcaagtacacagtaaagcattgtgaaagaatgactatttacttttaagaagggagtgactgcctcagttacaaattctccactgtcaattttttattccatttctatggaaaaggggcatctactctagtctagttacttcctgctgaatgagggtgttgattggggactttggattgaaactgtttgacctggcagcatgctatgttcaggtctttgttttgtttgtttgtttgttgttttatttttgggtccttaggaggacccagtccaaagttggaaagtatatagggccatttctgtggtgagtgttcccattagaagtaaatttataaacaggagttagtattgtgcctggagtcttaacaaatttggctttttttttttttttgtatcagttggatttcccaccatggcagaaacttgaaatggcctactataaaatatgttaaaaggactcaatttgtgcctgtttcaggaagccatttacatttataacagggcaactgacaacaccttctctcaagtcaaatggggttttggacatattttgacaatgtattttttttgtagcatatgtttaatcttttactttttcccttatattgtggtctccaagatgacaatcaaaacgttgtaggaaggggaaagtcacaatttctcctgacatttctgtaatcaaatggtgacatttctgtaaccatttgatagaaaataccaaaatactagcagtggtctagtattttggaatactagcagtggtctagtaatttgaaatactagcagtggtctagtattttgaaatattagtctttgaaacagaggatagacaggagttaactagagaatatatggtccccatatcaatatgaaagtcagtaaatttgcttcccactgttaattgtacctgggctcctgtatggatataatgacaggttggttaaacatacatattcaacaggttatagaagttatgaatatttataaaggtgattctgacacatgcatattgaacaaacatatataacatatgaattatgttcatcttggagtggagacctaaaatttaaagtattacaactaggtcctatacatcaaaaggttttttcaggacacaaaggcacacaaatacacaatctctgtaaactagtcagaaccagtccatggtcagtggtattcttatcttgggaaagttactgaaatcagcctcttgtccattcaaagttatagttatggttagtggaacatgggcagggagcatgggagatctgttagcatctggtggaaccgtaaatcattttaatattgtttatctcaaggtcagtgcttgtttagctgctggagaaaaacaaaaaccatgtggcagttagaacgtagtttattctttaagtgtagaggtgcatgacttggcccttgcctgacatggacttaggttctatttataatttggtatcttattgccacaaagaatgttttgtcagtcttatgatctgtattttaacattaatgctgctcagctgttgtgtctaaaccataaaagggaggaagtataatgagacatgactgaccttttataccatcatggctgggaactgggtttttaattttttttttggagccaggggtggagggtgtcctcttggctccttggtctgttcagtcagtggaggacttaggatttttgttgttgttgttgttgttgtttatattcctccttctttgggcaagatatgccagagacaacatcaatggccaaggttttattttgtcccatatcattgccagagtggtgcggctacctgtcctggtccatcatgtccctcagtgggactcctatggccaaaggacttagaaccagaagacttatagccaattaatcattccagaccaggcaggaatggaggtgggaaggcactcattaactcttaaaaccttttaggcaacataagagttaaaaactaaaagcaaaaatgcaagtttacaaaattgaataatttataagttctacatattgagctgctgtttaagcatctgtatacccatctttgatttggaaggtctgaacaaattttatcccacaaaattcacttttataatctcatgcatccacctcttctacaatagtccttgggcttagagggaaggtacttgacattatatagctttagtagcagtgcataggcaagccaaaacatattgactcagtaggattgcacaattttcaaattttggagatattaggcagagagatattttttgttgttgtagtacccaatttctgtatagctgtaaatagctcaagaggaaaaaaaaagttttcttgactttggaaaacaaaatattaaggattagcaatgttttaaacaaaaaggtcataagcctttttcaagtcttgataatgacagaaaaggaagctcacacatagttaaaccttcaaattatttagtgatatagattgggtgtgtccccacccaaatctcatcttaaattgtagttcccataatccccatgtgtcatgggagggacgtggtgggaggtaatttaatcatgggggtttttaccctcatgctgttctcataatagtgagttctcacatgatctgatagttttatgaggggcttttccccctttgcattgcacttctccttccttccaccatgtgaagaagaacgtctttgctcccccttctgccatgattgtgtttcctgaggactctccagccatgctgaactgtgagtcaattaaacctctttcctttacaaattacctagtttcaagtatgtctttagtagcagcatgcgaacggactaatacatttagcatcaaggatctagaagcaaaattattaaaggagtcttagtgtctttgtattagggcctgtccacatgtttcatgaaagcagttaaatattttgattgtcaccttctccaggtctaaagtccagcctttggttaacttaagtttggtgtcagatactggcatcaacgtttaagatttagcagcagttcatggatatgtatatccaggagtcaaaaccctgtaacttaacggcacaagtattagttaatagcacttaggaccttttcaaggagcttgaggtggtgatattggagtttatgacctgatttaagagttacaaaaagattctacaaccttgtagtcattcatttttatagctttgttaagtccccagcaataagtcagagacttaggattttgatttcaagaatatttattaaagatgttaaagcctcaaaacatttcaccaaaacaaaaactatttgttcatttaaccaagattgataattaaaagactttaaaagcaatatgcaaagttatatgaatataaataccttaacccttttaaattttagttttcctaaagaatcaaaaacctacgaatataatatagaaattattttgctattaataaaatgtaaaatcttcgttttttaagccaagtaccaaaaaggcaaagaaaactttctgcagtgtaattgcttctccttatgggaagcccatttagataacccaaaagtcaaagctgttgaaaagagtacatgaatttaatcagacacaggaagagtcttttcaaggttatgagtatagcaggcgaatacatgactcttagtaatagcatgagaacttcctgattacattgaaaaatttagacttatcaagaaaaatcaagagtgcagataaacttatactggaggtaaacattgcttttttagatctttaagataaaacattttagtggtaggccacaacaacagttggaactagagggaaaaaatttcaggagtgatgaaaaaactgaaggagagagttgtcatctcaagccttctcaaggggaggaaaagctgaaagcaacaagacacaaccaatgttgaacctctgagatatgaatctaagaatttttaaaagaaattggttatataattaaaaatcaaaacctcttgtaatttccctaaaagccaagtaataccttaagtaacccttgttttaatgcaaggggctaacttttagaaagagtattatagtggtttcctttttaattataaacaattaattacttacaacattcctcttataaattctgtttcttgtaccttataaccacttacacagcccatttataacattttttactttcttacttgtcttatattacacttctttttaacaataaccggttattttactttaagacaaaaatttaccacacaagatcttttttagataaaattattatttttaaacaatcttacttaccaaaaatatttttatattcataacttttctcacatctcttttaattcctattttctttttacctttttttaacttttgaataacttctaaattatataaaattattctttctcaagaacacaacttacagaattatataagaattatatattaactaggattcttattcttagtaaccttaaattttagtgaaaacctaggaagcaagaaatcctgaactgtctatcagatggaacattttatagatgaaaccactccacagttttagaaatatatttcccatattgtaaccctttcttagttagaaatgacccaaatattcaataagcatccaaaataattttaagattttaaaattacataaaaagtttacctggaagcatttatcctatgtttatgcacttaattttttaatttttaatagtttatctagattacttctgcaaaatgaagatactagacaaaactagttgtcatttaaagttatttctctgttaatcatttataaagcctgtgaacatcaggtgttcacctaagaaccttaaacacaagggcattttgccaataattcagaagcctgagctgtttttattgaacctgaaatatttagcaaaggtagatataaaatagttggtgtgagaaaacactttaaacagtctatttttaaggtgtgataaatctaagtacgttcagccagcctgtggatgtaacaaaccacacagctcacgcacctagaaggtcagtaagcaaacagaatgtagaggagaggtcagcccataaaagggaagaaagttttgttactgggaaatcaaaacttaagtggagaaggggactggggtaaaaccttataagagggataatgaaacttaggcaacatccaggaagattgtaaccccatagtacttgactagtgaggaactgggggagggacttattacatgctaggggataaattacctgctgtaactgccccaggtgtgcctgcctaccagacggccagtcttgcaagactgccattaaaagtctcgcttctgctgttcttcatgtctccaagggtttggccaggtgaatatgtgtttctcacaattggtatatctagacaaaaatgaatgccaacaatttggaagatatatctatttttatttcattaatgatttcaaaaccattttttatttaccaaaaattactaaatgtacctgaacttgaaaagcatttcgactgacttaatttatgaatactcatttatttataatccagtttggtacatgttagacacaacacatatatatacatacataagcacatataaatatgtatacacacatacaaaccaagatccaacagcttttacctcagagctctagccatcagagtatatcacaaactcactggcctataaaagatagctgtatccaaaattttttcattaacaaaactggggccgggcacggtggctcatgcctgtaatcccagcactttgggaggccaaggcaggtagatcacaaggtccggagactgagaccatcctggctagcatggtgaaaccctgtctctactaaaaatacaaaaaaaattagccgggagtggtggcgggtgcctgtaagtcccagctactcgggaggctaaggcaggagaatggcgtgaactccggaggcggagctggcagtgagctgagatcgctccactgtactccagcctgggcaacagaatgagactccatctcaaaaaaaaaaaaaaaaaaaattggaacctgtctacatggctaaactttgtctcaataggtaattgcatgaaagctgttgaccaaaatttttggtaaagcactttagataccagtttaatttttgaaatctcttttacccttttttttaagtttcaagagttttcaatgtttacattttaactagaactggctgaactgtataagaaaaacaaaatatcccaagtaactttgaattaagtgagttttatctcaatattagtagctcaatagcagcagattcaaagtagacagaaaagagagaattagggagctttagaagcctctacttaactctatagttgctggttaaccatttgagccctgaatttttcttgctgtaatttgcccatcagtttaaaatgtgcacaaaaatggggataatatgtgaccagctggagtcccagaaaatctggcatgtctttgaactttcatgtttcaccttttaaacaaccttttaaacaattaaaaaccaaaaaacatacaaaacctaaaacagagcattcccaagctaattcccaaaaaaagggagactgaagagatgtcttcaaaaatcttatctgacaccaaacagtaccacaaatgactcatgctaggtccaaatggcacaagcccaaaaggcagaggctgaagattcctggtgtgcacatcagtttcacttactcaatcttggatccatcaactcccagatactgctttaccttgcactgactaagcattgcaatcagctgatgccatgaaggggaaagaagagagattccctgagacaaaagcattctcagcagctgctgagttcccagaaatcccagctaggatcctaaaatcccagctgcaaggatggtcttgttaccaaaacaccaggggttcgtctaggtcctggggttcatctaggttctgctgctcactgtatagaaagctaatgactggcacaatgagtattgccaagtgccaaggaagaaggctttaagcgggtgttccggtagagaagatgagagctcagtctcaaatccatctccctgattgactgaaattaggggtttatatagcaaggaagaaatgtaactatatataaaacaggatctcaggagtaagaaggcaatcatgatgaatgaggggcctggcatttcattatttgcatgccttgattgggtgagtttcagttcgctgatactttttgaaaggcctgggaatcttttcctgaggaaggaactcagataaaacaaatgtgaagtttcaagccttaagtttgcctggagaatactgcactgacagtgagctgcactcttttttttttctaatggggaaatggattaaaaccagaggatcaatttctatgtttatccaaagacagctgtctatgggactattgggttagtttcaggttttataacctgatgtgatttggctttgtgtcctcacccaaataagttttggcttttgagcagtgagcagctaaacctgagttcagttgcactacctgccacaaaacgtttaactagcaactatccacagacaaaaatgccttggtgaaagcctcccaaactggaaataagcctgagtcacctaggtggctcataaaatgtaataaaacccacatgggaatggtaagagaaatggtctttgactgtgctgcccctccccaaccccaagtcagcatagtactacatagaaaggatcccccagggatcatgctttctacagagaaaaaatggaagcagagattgacatttagattccctagcattttaaaacactttccagggtggctagactacccaggttcaggtagaaacaaagaaagtggagcccacagcacccagcacacatcttggtggtagctctgcatacctgccaatggtatcagagctcatgaaactcagctggtcactcgcaaaactgataaaaagttttacctgcctggaatccttagatggccaacctgtaggaccagccttggattgtaccttgggatcccacccaggaatggagacaactactacagcgaatttcagcaaagagcaggggctagttccacaactcctgggaggttaacagcacttggcgaaaatcaggggttagatttgtacccctccccgagaatttaaatagcactcaattcagcctcaaagctcacctcaaaaccctgtgaaggcagagaggtaaacctccattgtacatttctgctttgcatagcaactggtcctgtccattccaatcagcaactgcacctaacctccgggcccctcctgcaaccctgtccaactgatgaactcaaatagcagtaccatatggccatggaatataccgtgtgggctggccaaattagaggtgattgcagtactcatccagcagctcagcataatcgcggagcccagccagctgccccacctccactcagactaaaagcaacagctcagccatttagagaatccaaacaagttctgttccccagtgttgttatccttgacccatccataatcactagctaaacagtgaaggtttatccctgccaaacacaccagaaacccagaaaaggtagctgtctcttcaaatgcaaagacagcagcaccagaagacaaggattgcaaacaactaggaaattatgacacttccaaaaaacaaaaacaaaacaaaaaaaaaacagcaccagcaaagcctcaacaatggtctccaaaaaaagagatctattaaatgatattaaatgacagacaaagaattcacaataatcttctttgttttggagacggagtcttgctcttgtcgcccaggctggagtgcagtggaatgatcatctcagctcactgcaacctccacctcccgggttcaagcgattctcctgcctcagcctcccgagtagctgggattataggtgcccaccaccacacctggctaatttttgtatttttagtagagacggggtttcaccatgttagtcaggctggtctcaaactcctgacctcgtgatccacccgcctcggcctcccaaagtgctgggattacaggcgtgagccaccgcacctggccagaataatcttcttaaagaaattcaatgaactacaatttacccttgaaccatgagtttgaactgtggcaatccacttatatgtggatgttcttccacctctgccacccctgagacagcaagaccaatcaatccctcctcttcctcctcctctgcctaaacatgaagatgatgaggaagaagatatttatgatgatttacttccacttagtggatactcatatattttctcttccttatgattctcttaataacatttttgtttttctagcttactttattgtaagaatacagtatgtaatacatttaacatataaaatatgtgttaattctttatattattggcaaagaatgtcaatagtaggctattagtagttaagtttttggggagtcaaaagttatatgcagattttcgactgcatgaggagtcggcgctcctaacccctaagccctgtgttgttcaagggtcaaatatacaactataatttgtcaatttccaacttaagaaacaaaaaaattaaaaaacccaataaaaagcgataaattatagacattatatttgtgtgaactttcagtttttgaaacatttttaatatttacatgaagtcaaagcaaatacccagtgtaggagaaagtaatcataaattttacctgctgttaatcatttaggaggtaaataaactctgagtgaacacattagtttattgttttcttttctttttttctgtatcaaaccagatttttaattcaacaatgaagtttcaatgcagtgtattatttatttcacattttaaaactttaaaaatttacatatgtgtatagtaaaagcagacaagtatatataagaaatacaaatgattaattcagaagagttaactctgataagagaaggaaaaatgatgagagggattggagagaagctcaagaagtactccaactaatatttcattgcttaaaataataagttaggtaaatatggtaaaatatttaattagcaaagttaaattgtgggtagctgagtcttaattctattattctgtatgtttcaaataattcattaaaataaagaaaagaagatatgccttcactaataacaaaatccatacagaatcttggttatacttagcaagtagtatgaaagatatttttagacatttgctagatattagatgatattataaaagtctgaataaatacaagagacaagtttctggataacttaaccctttaaccctcaattctcccaatatatctgtaaaatcaatatatttcccaaacaaaatctaatcatgatacttgtatatttattccaaaatgtacctagaaaataaaagtcatatatatatgtgtgtatatatatatgtgtgtatataaatatatatgtgtgtatatatatatatgtgtgtgtgtatatatacatatatatacatataaaatgaaaaggcacaggtacaggaataaaaacaatgagctattcacccatgaataagacacaggaacaaagagactggaaggcaattcccatataaagatatgtctatgagaatttcatgcataataaagctgttgcgacaaatcattgggtaatctaatttgggtaaagggcttatcaaatagaaaaaactaaacttggattcttttataaaattatgtataggtatacaaatacattctaaattgcctacctccgaatggtaaaacacccattaatgcaaagatttggcaaagctctgggaaaacaccctctttctttccttagaggagattaattgctacagacattccaaaatctaatccaatagaactattgaaaggaaatatttatgtgctttgttactcagtagaaacactctcaggtatattgcctgctttcatgcagatcaatatggaaaaatgaatgaataaatgcttaaagtagctttttctgtttatttctctgggaatgaaaatgtaacatatgggatccacataatggaattactattcaaaactcagaagcaattaactacttttatataaagcaacactgatggatcttaaaaaatacacttttgaggaaaaatgtaagaaactgcataagattattttatagaaatattttttaaggaaataaatacatgtataagaacatacagttgtagctaaatatttgtcacatgtagagtgtagaataatagacactggagacttgaaagggtgggaggagggtgagggatgactcagaaattactcaatgggtacaatgtgcattattcagatgatggttatattaaaagcccagacttcaccactactcaatatatcatgtatctaaacttcacttgcacctcttaaatttatacaaataaaaaagtatatctgttatatacatatacatatatttatgtttgtttatttatacaaatgtaaataacaaatcctagaacaacttaagatacagatattgttaagtttgtgttgcagaagaactagtgtagactataagtaacatgaatagtcacaaacacagctaggatataattgaagccagtattctaaccttgtctgtctggccccagaattcacaagcttaaccaactgtgtgtgcttctttgcatatatcaactattttagtgcttacctcagagagaaatgaagcagtcatggggatggataataatatgaaaccagttagcatcttggatgtactgctgagaatgctgtgatgcaattaacttgactctgtgaacctgaagagaaaaataaaagaggaccagaaaaaagagaaggccaggcatggtggcctacacctgtattccaagcacttagggagcctgagaaaggtgtatcacttgagcccaggagtttaagaccagcttgggtctctttaaaaaaaaaaaaaaagggtaaataaacttctgagaaactaaagagactaagtgatcagcataaatactgtcagggaaaagaccagaatacaaaaaaaattcaaattttagggatgaatatgtttacacctcagtgaccatctgtgttttactatgcagtatatctgagatattaagcaatatcagatatactgagatgtttttacttttaataaaaaccagtatatcttagctattgcttaatagctaagatacttttattaacaaaaatataattattaatgctcattagtacatttctatgtgattttggataacatttaacatatttttgtctaagtgttttattactaaaatgtactgttccttaagagtttttattgtaatataaaccacaatggaatatttgaaattctaaaatagatttagtaaagagatttttcatcaatcatttggtgatatggaatgcttaatttaatggttttttttttttttttggttactcttttctctttttttttttcgcacaaatgtgctaaggtttaggagtgaagtgtccagagttgtaaaggagagatgaaggagaactatacagacagataaataagctaatgaaaactggctacagatcaatgggaggacaaatttccgcattatatctaattcatgttgtttaaagaaatattgagccaggcacagtgttgcacacctgtaatctcatctactggggaagctgaggcagaatttcaaggctttagtgaactatgattgcatgaatagcaatttcatcccagcctgggaagcactgggagactctgtatctcaaaaaaaaaaaaaaaaaaaaaacaaaacaaaaccgaaaaccaaagaattattattttgctcttttataacatgcattcatatcattaactctaaataattctgatgcactaatatctgcttaaagtcatcaaatcatggaatttgtagccatgaattttgtcacatgaatagagaacagaggtaacgaatgacagtaaattaaaagctactccttctgagaaaagagttttactgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttagatctaacgtttaagtctttaatccatcttgaattgatttttgtataaggtgtaaggaagggatccagtttcagctttctacatatggctagccagttttattttataattttaataaatttatattaaaatttattaaatttattaaaattttataattttaataaatttatattaaattttataatttataaaattaatttattttataatttaatttataaaaatttataaaaattttataatttaatttataaaaattaaattttataattttaataaatttatattaaaattataaaatttattaaaattttataattttaataaatttccagcaccatttattaaatagggaatcctttccccattgcttgtttttctcaggtttgtcaaagatccaaacaccgcaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgctgcgcaccagcatggcacatgtatacatatgtaactaacctgcacaatgtgcacatgtaccctaaaacttaaagtataataaaaaataaataataaataaataaattaaaaaaaagttttaaacaacacattcaaaagaaataaaaatacataaaaataaaattttaattaaactatttagcctgtaagaacagttaatgacacagcttgcatagtgtttctaattttacttttgctttgctagagtttctgtgtttctgcaggtttaaaatgcaaatgtactaaatgtgcactttaaaacaactttatctttcttaagtcttgaaactttatgccatatttttatattgaaatcaccaagttataacttttttctaaaaaaaaatcctaaatattacctcctttaggagtagtcagtagctctttggcagtatcagatgcctaagggaaatgattttccctttgaaagactacgtagagattaatgcttgccatttcatagctcattatcttgtaatggttccctctaaaggcatgaaatgtccagaggttcatatgaatacttttaaaataaggtgctgtgcacagagaacattcgttatggtatttttctttgaaagattcctgatttcaaaataaatgccttgccttataaaaatgaaagcatctgtgttgctggaaattattatcttccaataatagttaaacaaaacatcatttttttcaaggacaatagatccagttaatctcagaatagcaattttaaaggcttgtgtagtggatgaaccattttacatgggttaatttttttgaaaacaaaagcttgtatttctaagggtaaaaaagctttattttaattttccagttctgcaggaaatatttccaaaaatattttacactatactctttaagtagaatatgcttgatttattaattcagggactagtcaagtattttggactgctaacctttacagtaaatgatcacactgaactttttacatttttaaggtttattttcatgatttttttttcttttcccactttatctgaatacaacctatcagaactagaactagttagtacacttagttctagcaaccactttacattttctaaatactttcctgctcttaaactgtaaaacaaatgtgatagattttttctgaaatagtgataaatagagaatactaggggattctgctgttaataaattgcatgtttgtttattaataaagttagtgacatttcctaaggtagttcaaaggtcttttcatttgcatcttattgactgtttcctgaggggttgacatttttgagtacatggattctggatactagttgtctgactccttttttgagagagtttattttcctaatgtaagaacataacaaacttgtcatatacctggagaagtaaagcaatgtctactatgtcattttattgatgatttattcacaaatctctctgggagaaaaaagtaaaaaacaaaataaaacataaagccagcaacaacaatctaagcatgtacatagcatgtgaagatcaatgggctaaaattgacatttatgaagctgggtcaggcatggttcccatcattaaggatattacaccaatgggagatgttaatgtaaacataattccaaatataatatgctaagtgctatgaaaaagatgcatatgggttagcatgaaacctttgaagagacataatctaactgcctggaagggtcaggaaagacttcaaaaagatagtgtcattttagttaggtctaggccactaaaagaaaagcattgtaggcagaggtaattgtgtgagctgggtgagcgaaaaccagaaggcaaggaagaatatacttgtttgagaaacagtgctcttgtgaaggcttgttggacaacaaagtagatggtgaggctgcaggacaggtttgagttaaacttgaaaagacacaggctcttcttcacctgctggtttcagtgtgtctctagatcaggatcttgagataatgatccattttttttcttagagtataagactgttatctgtaattgtcacagtaatgtctttctttttatttttcaaaaataacttggagtcctttgattcccaaatttaccaaaatagataaaatatttaaaccttttttatatcactgtttcccaatgtttgctccacacaaacccgctgtgtgttcatcggaattacattttaaaaccgtaattcatttcatttccaaatatttcacttacaaatatttgatttacaaaaatttcatttagaaatatttatagtcaaattatatgccaatcattgtttggtgctagagattgagtagtgaaaaaacaaagtccttgcccccgcagattttgtattctatctagaaggagacaaataaagcacatgaaccaattaaaaatgagtatgtaatatgttgattagaaataagtgctgcaaaaaataaggattaaaaatagaaaattgatgacagttatagtaggaagggaaatcagaaaagccctctgtgaggaggtagtatgtaaacaaagacttgaataaagagggacataggtctacacatcagtgatttttcctatataattcaagaataaatcacagattttctgcccgtttactcctaaatatttcattgtacattgcttacaaagaacattcttttacttaatcaaatttatcataatcagaaaatgtgatattgatgtaatactattgtctacattatggtgtatatttgaatttagtgaattgtaacaataatgaccgttacaattgttttttccccaacttaggatctaatctatgatcaggtatttcatttagttgtcatgtctctttattgccctttaatctaaaaaacgttgtactgccttctactatcttcttatccttgtcgttttttaaagagtataggtcagttattttatacaatgtatccaatttttatttatttgctgcttcttcatgattagattcaaattgtacattcttggcagaaatatactgcaaacatgatgtgtcttctcagtacatcacattaaaaagcatattatcttgctttgttccaatatttttgatattaattttgatcagttcattagatggtattcacccctttttccaatggcaaagttcctatttttcccctgaaaactaattatttgtgggcggattgaaactatttcaatatcccatgtctaataaaaattttaccactgcaatatatgattttctaactccatcattctttctatatatattagttcaccttccacagtgttaaggaagatattttgttgcttcattcattcatttgcatcagtattaaattatgaatttctatttttttcaacaagttataatgcatgactataattatttaatttgatattcaaaatatctcaaatttggctgggggaactatttaaggacttcttttattcttttcttcctttttgattttttaattaacaaataaaaattgtatatatttatggtgtgcaacatgatgttttgaaataggtatgcattgtggaacggctaaatcaagctaatttacatacattacttgactttttttttgtagcgagatcacttaaaatctgttatattagcaactttattgtgtaaaatacgttgctattatctacaccaccatgccctgcaatagatctcttgaacttattccttttgtctagctgaaattttgtatcatttgactaacatttccccaaactaccaccccaattcccccagccccaggtaaacaccatttttctactcaatgcttttatgatttcacctttttaagatttcacataaaagtgacatcatgtggtatttgtctttctgtgcttggcatgtttcatttaacacaatgtcctccagaattattcagattttctaattgaacttgtgtcagatttcataacctgaacttgaaaaatggcttttacttaaatcattgactactgtgctatcctatagttgtttaaaatcgttctttcttattttttgatgtttgcaacgatctatagtgttatcctctcttaattcctgttattgatattccttgggtattgatattgattttctctttctttcttgatttgttttactaatggcttatcaattttactagtctttttaaagggtaaaccactggctttgttaaaattttttactgtttgcccattccctatttcactgatttctgtccttcattattgtcttttttttaacttattttgggtttatttgcacatctttccctaacttcttatggtgcaacctaagtcctatatttaaaacatgttttttccgattataaaaatataaattcccttttcagcattgcaactttcacttccagctatgctgtgctacaggaaataccttcaggcaaaaagtcacgtacatatgattcttccatagttcccttctttcaagagttgactacttctgattttctgccaaattttgttcattattcagtgtcttcaaatagttgagttaggacattgactgttttagtccattcaggctgttatattaaaaaaaagatcacaaattgagtagcttgtaaaaaaacaaatttattctcacagttccgacatttggaaaggtcaagacattagcagaatagtgtctggtaagggcccacttccttcacagacatatcttttcactgtaacctcatatgactgaagaggctagctagctctctctcactatttttataaggatgctaagcccaatcatgagggctccaagcaacctcagaacctactcacttcccaaaaggccccacctcctaacaccatcacatcaggggttaggatttcaacatatatatttgtgggggacataaacattcagactgtagcaatgacattgtataatttatattttaaaagacctatgttgtcttttctatagaatatagattgcattaaggataaatgtgcaaacaaaaatattagtaggatgccaatagcagtagttcaggcaaatagcgattgatcaaggtaatagcaaaatcatctaatatagaaagtattttgactgtagagctgaaattgtatactaattaattggatatcagttattagaggttttacagaatcaaagatgaacccctaatttttgttcttttataaaaatctcaacattataatgaagtgtgatgacataaagtattctgaacactgtgggattggagggagaaacagagtttgggggtttaacagtatgtcagtttacatatacgattgagatgtctattaaatattccagtcttgattataggagaattgttggcactgtgtatataaatgtaggtctaatatatatatatattttttaattcttttttttggacagagtcttgctcaggcatggtctcagctcactgcaacttctgcctcccaggttcaagcgattctcgtgcctcagccacctgagtagctgggattataggcatgagccaccacacccgactgatttttgtatttttagtagagacagggttttgccatgttgccttgcctaggctggtcttgaattattggcctcaagagatccatccacttcagcctcccgaagtgctggggttactggtgtgagccatcacacctggcctaatatgctttttaacatgtagaattcattgagatcacctgaagatggatgtaaatggagtatagatgaagatgaagaagagtccattttaatagtttaggaagaggcgaatgatccacctaataagactgaaaaggatctgccactgagggaggaggaaagtagaaagaactgtgtccctgacaccaagaaaaaaatttttccagtaagggactgatgaagtttactaatgattagaattatatgtacaatcaacatatataaattaaacatatctggggaagtatattaaacataaacaataaactttcttactgccaggtggatagaatgtacggtagtgcccaaactatttgaccatgcaatttttatgcaataaggttatcatacaaaaatattattccatggaacaatcttgtggaaaatcccattttgagtcacaatgagaattatcaagctctctgagtgctagaagtttggggtctacaaagttagtatcatttatatttcagaaacttcttaatatttgaagttttaaatataacaaaattactataaagtctttcattcttttttaactttttaaaacttcttttgagctgtgcaatttaaaagacttgaaattagtagaagaatttcacagttgtcaatttatttggtgctaggggccaattcaattagctaggaacgtattttcaaattgttaccaattggatcaatggagtatgacagctttccccttcatttctgtttctagggacaagatgttgaaagaaacattctgcaagactaattactttttagaagataggacgtttttcctcttctttttaaacattactagggaaaagggatttatttttaatttacaaagaagggctactgattacattaaacagggacacaatgtgaactctttctatgcaagctgcaagcagagttctttggttcaggtggattccagccaagcttcaattctttttctgttttcattcttttattttaagttcagggatacatgtacagtatgtgcaggtttgttacatagttaaacatgtgccatggtgattagctgtacagatcatcccatcacctagatattaagcccagtctccattagctattctttctgaatactctccctgctcctatcccccaccctcccacaggcccgagtgtgtggtgttccccatcgtgtgtccatgtgtccattattcagctaccacttataagggagaacatgcagtatttgattttctgttcttataatagtgtgctgaggatactggcttctacctgcattcatgttcctttttaggaaacaacctcattcctctttacggctacctagtatttcatggtgtaccacattttctttatccagtctatgattgatgggcatttgggttgattccatgtctttgctattgtgaatactgctgcaaggaacatatatgtgcatgtatctttataatacaatgatttctattcctttgggtatagacccagtaatggaattgctggatcaaatggtatttctgcctctaggtctttgaggaatcaccacacagtcttccacaatggttgaactaatttacaccccccaagaagagtgtaaaagtgttcttttttctccacaacctcaccaggatctgttgtttttctgactttttaataatagccattctgactggtatgagatggtatctcatgtggtttttatttgcatttctctaatgatcagtgatgctgagtttttttttttcatatatttgttggccacatgtatgtcttcttttgagaagtgtctgttcatgtcttttgctcactttttgatggagtttgctttttttctttaaatttgtttaagttctttgtagatgtgggatattagacctttgtcagatgggtagattgcaaaaattttatcccattttgtaggctgtttactctgatgatagtttcttttgctgtgcagaagctctctaatttaattagattccatttgtcaatttttgcttttgttgcaattgcttttggcatcttcatcataaattctttgcctgtgcctatgtcccgaatgatattgcctatattttcttctgggttttttatagtttggggttttacatttaagtctttattccgtttgagttgatttttgtgtatggtataaggaaggggaccagtttcagtcttctgcatatggctagctagttattgcagcaccatttattaaatagggaatcctttacccattgcttgtttttgaaaggtttgctgaagatcagatggttgtaggtgtgtggtcttatttttggtttctctattctgttccattggtctatgagtatgttcttgcaccagtaccatgctgttttggttactgtagccttgtagtagagtttgaagttgggtagcgtgatacattcagctttgttctttttgcttaggattgtcttggctattcaggctctttttcagttccatatgaattttaaaataggttttttctaattctgtgcagaatgtcaatggtagattaatggaaatagcattgaatctatcaattgctttgagcaataaggtgattttaatgatatagattctttctatccatgagaatggaatgtttttccatttgtttgggtcacctctgatttctttgagcactggttttagttcttcttgaagagatctctcacctccctggttagctgtattcctaggtttcctaggtattttattctttttgtggcaattgagaatgggagttcattcctgatttggctctcaaattgactgttgttggtgtataggaatgctcataatttttgcacattgcttttgtatcctgagactgctgaagttgcttatcaccttaagaagcttttgggctgagacatggggtcttgtagatttaggatcatataatttgcaaacaaagagtttaactttctctcttcctattagaatgttttatttctttctcttgcctgattgccctggccagaactttcttttttttttttttgagacggagtctcgccctgtcgcccaggctggagtgcagtggcgcgatctcggctcgctgcaagctctgcctcctgggttcactcctgcctcagcctccccagtagctgggactactggcacccgccaccacgcctggctatttttagtagagatggggtttcaccgtgttagccaggatggtctcgatctcttgacttcgtgatccacccgcctcggcctcccaaagtgctgggattacaggcttgagccaccgcgcccggcctgccctggctagaactttcaatactatgttgaataagagtggtgagagagggaatccttgtcttgtgctggttttcaagtggaatgcttccagctttttgctcattcagatgttattggctgtgggtttgtcatatatggctgttaatattttgaggtatgtgccttcaatacttagtttactaagagtttttaacatgagggaatgttgaattttactgaaggcattttctgcatctattgagataatcatgtgttttttgtcttctatttatgtgatgaatcgtatttattgaattgtgcatgttcaacaaccttacatccagggatgaagcctacttgatcatggtggatatctttttgatattctgctggatttgatttaccagctcttcgctgaagatttttgcattgatgttcatcaagaatattagcccgaagtttttgttttgtttttttgttttgttttgttgtatctctgccatgttttgttatcaggatgatgctggcctgatagtatgagttaggggggagtccctccttttcattttggaatagtttgagtaggaattgtaccagttcttctttgtacctctggatgtattcagctgtgaatctgtctggtcctgggcttgttttggttggtaggctatttattattgcctcaattgactcttggtaaataatgaaattaaggcaggaatcaagaagttctttgaaactaatgagaacaaagatactaggtaccagaatctctgggatgcagctaaagcattgttaagatggaaatttatagtactaaattcccacatcaacaagctagaaagatctcaacttaacgacttaacatcacaactaaaagaactagagagccaagagcaacaaaccccaaagctagcagaagataagaaataaccaagatcatcccagcactttgggaggccgaggcgggcagatcacgaggtcaggagatcgagaccatcctggctaacatggtgaaaccccatctctactaaaaatccaaaatattagccaggcgtggtggccggctcctgtagtcccagctactcaggaggctgaggcaggagaatggcttgaacccgggaggcagagcttgcagtgagcagagatcccaccactgcactccagcctgggccacagagtaagactccatctcaaaaaaaaaaaaaaaaaaaaaaaaaagaaagaaagaaagaaataaccaagatcagagctgaactgaaggaaatggagacataaaaaacccttcaaaaaatcaacaaatccaggagctggttttttgaaaaaactaatataatagatagaccactaattggactaataaagaagaaaagagagaagattcaaacaaacacagaataagagggattcaccaaaggccctgcagaaatacaaagagccatcagagaatactataaacacttctatgcacataaactaaaaaacctagaagaaatagatacattcctggacacatgcaccctcccaagactgaatcattttttttctcttctgttttcagagaaagcctgtgactaatactaccttaacattgcttgctccaggctgaagcctcctagtaactcacataacaatatttccccaaattgccatgatttacttagcatatgttaacatattagcagcactaagtctaagtgttactttcctgcctttgttttttgaacatcagtcaattttgtaaaatgtgtttaattgtattattgattattattttcctttttcaatttgagttcttgggatggcagttgagcactggggaggaataccctccctttccttagaatttaaaaatcattttgtggcagctacaatattctctataacatgagggacacaacttgtcccagaaatatttctaagggaaatattgtctgtgataatatttatcactgataatttcttaagtgcctaaattctaagtttattactggttatagaataattgaaaccactgtaaaagattaacatatcttcaaaaatgttctagttaattttagggatcttataggtcctattagcacaatcattcctagtcatttttagcaaaagtatgtgtaaaaatatatctagagtagaacatacattattcagatgacagacacactaaaagcccagacttcaccattaagcagtatagccatgtaacaaaatagcatgtatatctcttacatttatacagatttagaaaaaaggatccaaagttggccaccctgggtagaaaaaaaagaacaggtatgaaaaatggaatcagaatgtagacttcatttttttctacttccctaaagataatttgatctaggcttcaggttttgtgttctccaaatgaaaaccagacatcattttggcattttggcccccaaaccagcctggaatagggacccactcaataaaaaactcattccccaaagagacaacaataaaaatctgctcagatgcagaaatttattagaagagacatgttttgggccaggtgcggtggctcatgcctgcattcccagcactttgggaggcctaggcaggcagatcacgaggtcaggagttcgaaaccagcctgaccaacatagtgaaatcctgtctctactaaaaatacagaaaaattagctgggcgtgatggcgggcacctgtaattccagctacttgggtggctgaggcaggagaattgcctgaacctgggaggcagaggttgcagtgagccgagatcacaccattggactccagcctgggcgacaagagtgaaactctgtctcaaaaataaaataaaataaaaagaagagatgtgttttagaattggaaaaaaattaagggctgtaagtttttgaggactttagatatcaataaacacctctttaaatcttcataaatttgtgattattctattaagcaacctaaatacaatagtcatttatttttaaatgactattaaagatatattatcaatttaataacagttttgtagggtaaaaataagcactaaattttatgcattcaccaaagaaaagcctaatcctgattttagaaatgttaaatatgaggaaaaagtgcaacttagaattgaggagatactgtataacacatcatggctattttcaaaagctacgtaagagattttatagacccctttaaaattgtgccatttttgcgtatatgtatttttaaattttagcttaaaatattccatttatagacttgtaaatccactacattatttgccccaagaagatgcctgctcaacaaagcaaggccataaattgtcatttatatcctaaggaattaaattcagaggcattacctattttacaaagcccaggaattcatctctcccattcataggtcaacacttggcttatatatgaaatttcattatatgagtatttagttgtaccctgagtgtgtgtaattcgttatttggaggtgttctctgcttaaactgagtgtgtacctgtaggcattgaggaagcataatgcacattgaagtattatccctcctatgttatagatgttcttttcttttctttgttgttttttttttttttttgagacagagtcttgccctgttgcccaagcaagagtgcaatggcacgatcccagctcactgcaacctctgtctcccatgttcaagtgattctcctgcctcggcctcccaagtagctgggattacaggcacgtgccaccacacctggctaattttttgtatctttagtagagacggggtttcaccatattggccaggctggtcttgatctcctgacctcgtgatctgcccgcctcggcctcccaaagtgctgagattacaggcgtgagccacctcacctggccagatgttcttttcttatcactaacaaaagattaaatatggctagcatagtattgctttaaactgtgatgaaatatgactttatagcacttctttgccttatgtcaacatatttgtttcctttttatgttttatttgtccaacctgataaatttagttttgaataagtgtatagctttattattatcagtaagattcttttttgattgggaaacttaaaaaatgagttttgtgtgactcattcatgggagatgatataaaagattcagaggtttgagatactgagataagacacttagtgtcacaatcaaatttgaaatcatatatggaacaatattgtttctatggagcagaacaaatttacagcatatgaaattgtgataacttcatagaaaaggtactttttgataagattttcattgcagcagatatatcttttgatatatacacttaagtatacaagaaatgtttcctttcttttttttattattaaattaaatttgattcaggcacattctcctgggaaggaaattcaatcttgttatcttggataaggaaggttaggatctttttgtaaagaagtgccatgtgttgtgcttggtaattttatgtgtcaacttgttgatccatcagatgccctgatatttggttaaacattgttttaggcatgtctgtaagggcatttctggatgagattaacatttgaatttatagactgagtaaagcagtttgtcctcccagatgtgggtttgcctcataaaccactggaggcctgaataaaacaagaaacagagaatttactctctttgcctgttttcaggctgggatatcaatcttctgccctcagccatcctggctctcagggctttagatacagactggaatctataccatcggctctctagctctcgggcatttcagttacacagccagcttttctgggtctccagctgaggggagattatggtactctcagcctccacaatcatgcgaatcaatgccttataataatttgatcaatctctctctagatagagagatagatagatcccactggttctctttctctggagaaatctgggtgataatatgtggaaaattccctttcttcttcattcacatcatcatattcactaatcagaacctcgtttctcaagtttgtgtggccttttgaacacacgtattttagttcttcctgggataagaacttttggcaatgtaaaaaacatcagtacctaaaatccagcctgcatggatgcatcatgttgccatttttctctgaggatttgataatctcctggggctaggcttgcagaaaaatccagaatggcacatttaatttgaatttcagataaatggcatgatttttaaagtataattatttgaaaatattgcataggacatacttatatgaaaaatatattcattattggaatttcaaatttcactggatatcctgcttttttatttgttaagtctggcaaccctaccagggacacagtcagtgagtggtacagatccacattatgctcagaatcaagaatgctgtcttcttcctgagactgaggaagaaaccagcccctctctatctctgcttattcctccctggtaattgttcccttctgaaacatagaactaatgcttctagatcaactaaggccaaggctgacaactgcaaatgcctacgtattccataatgggacatacctgcctatcataggcttagaggtgactgtggtaaactattgtaagttagcgaacagggtcagctgatattcagctccagccagatgcatcctgagactatgggcctagtgtcactaaaatttttaaaatctaaatccagacttttttttttgagaaggaattttgctcttgttgcctaggctggagtgcagtggcgcaatcttggcttaccgcaacctccgcctcccgggttcaagcgattcgcctgcctcagcctcccaagtagctgagatcacaggcaagtgccaccacgcccagctaattttgtatttttagtagagacggggtttctccatgttggtcaggctggtcttgaactcccaacctcaggtgatctgcccactttggcctcctaaagtgcagggattacaggaatgagccaccgtgcctgtttttttttttttttttttttagagagacagaattttgtcctgtcactcaggctgaagtgcagtgccatgattatagctcattgcaacctctaacacctgggtcgaagctattacctcacctcagcctctggagtaactgggactacaggagcaccaccatgcccggttaattttttaattttattgtatggacaggatctggctgtgttgctcaggctggtctggaactcgtggcctcaaatgatcctcccacctcagcctcccaaagcactgcgattacaggcataaaccgccatgtccagccccaaattcagatttttatggggagcctcctaatatttaacacacattaaaataattttacaaagtaaagtaaataatcagcaagttttactcagcccaatgaccttcagtggagacttctactaaaggtggaagtcaacattgcttccaacctgcctcagcttttaattctgttacagacacctcacctgagttgggaaagcccagagtgctattataaaacacaacataaataaaaacaatacataacactgtttgagagcttttgtgtaacagtgtgatgaagtatcatattgagaattcaatgacttgaaaagctgaaagtgattcatgcagcattaaagtcttatttgaaacttggttagtacttgttttatagacctagaggaaatcaatagtgttgtgatgttcaggtaatgtcccagaaaagtctgtctactctgaaaaattttcaagctcgtgaaacaaagataaaatgaaaatatgttaccttagtctttatattttatacgtgtgataatctttttgatttaataagatgcaattttctgttttcagttatgtcttatgacagaattcaattaaagtttcttatatttatgaatgtgttttgaagacctctttttcatataaaaaattttgtttgcctagcaatgttagtttctgagtgaaattctgactgtgtcacagtttcctctggtatatagttagtaactgtgtgacaaatagtaaaaatggctttcttttatatgcaaatgggacaaatctaatttactacatagattctaatcatcacttttggcaattgtacttaatgagtgaatatttctaaacagtcatcttatttttccattttaagttaaagaatattttagcatctaggtgaattattttgaagaaatggagaatgaccagttaaatatttatgcgtatttagaatcctgctttgaaagttaatatttcaaaaagaccccaacaacagtgcagagtaaataaatagcacacacattacaaagtcaattgacttttctcttcttaagcatgaggtaaagatttacttgaaaaaaatcaatatctagcaaacaggataatggctttgcaacttgtacaaccatgaggtaaaaaaaacaattacaagtttaaactataaaagtgcaatttgttttattcgtatttttattaaatgtcattgggtacacattttgttttttgagagaggtaagttaacaggtcattccaatcttctgttgataagttagaggggttgtctagtgccgtgggaggacaaaggagaggcatcaaacacaaatgatttaaactttgtgatgtaaactacttttaatttatctgaagagaacatctctctggagtgtggattattgaaaatgccataagagatttaggagagacagataaaacgtgtaggtctgtgtccatagtacgagtcaagaatatattttatcattcatggtgggagactttcgtgaaagggattactattaatatttacactgggacttcataattaacacgacattgcccagggaaaataggacatatggtcaccccatggatattccattcctattcagaaccaggaaaaataattaaatcatttcttacatgccacatttattctctattttataacaaaatggttaattcagaatttgacatttaagcattccattattacccatggaatgtcactttcaggagtcattgatattatttaattttagttagaatattaaacacttgtaaggtgaccaataggttatttctagctcaagatcaggacatggttttctcatcctcatcttagcagacattgactgtctagaagtcaatttttttaggtgctacctcttgttttagatgtttacaaagtgtaagcttattcctagagtggtctccattcaatattaaggtaacagaaaaagcaaatgcagcccaactgtaatagaaaaaggactatgtgggcactgagtgactaagataaataagtaaataatacaaaagtgtaatctgagttaagaaaagactctgctatctgtttatatatatctctgctattcgatacacctaaacaaagaaattgttttatgtcttttttttttatctttctggaacaaacaaatgtatctgaaatatttactgtcctacaaaaggaatagccatttatgaaacaaaatgtagattggcaacaatgataacaaaaataaataaattggcagaaacacaactattccattattcttgacacttgcttactattgttatatctggtatatttaataacagatcattagactttaatgcttaactgcaaaaatgtgcatttttgtgcattaagaattaaatgtgggcagggcatggtggctcacgcctgtaatcccagcactctgggaggccgaggcaggtggatcacctgaggtcaggggtttgagaacagcctgggcaacatggtgaaacccatctctactaaaaatacaaaaattagccagacgtggtggtgggtgcctgtaatcccagctactcaggaaactgaggcaggagagtgggttgaatccaggaggtggaggttgcagtgagccgagactgtgccactgcactccagcctgggtgacagagcaagactccatctcaaaaaaaaaaaaaaagaaatgtgaacattgccggtgttcaaacacaatagagcatttttacttgattttgtattagaataaattagttttgaatagaatatatataacaatcctactcaaatggattttttggacacttttcatagcatgttaggatttattttaacattccatttacatgtaaaattggttgtaagtagcttctgtgttagtcggttttcactcttgctgatagagacatagccgagactgggcaatttataaagaaaaagaggtttaatggactcacagttccacaaggctggggaggcttcacaatcatggtggaaggtgaaaggcaagtcttatggcagtagacaagagagagtgagagccaagtgaaagaggaaaccccttataaaaccatcagatcttgtgagacatattcactaccatgagaacaatataggaaaaaccaccccatgaatcaattatctcccactgggtccctcctacaacatgtgagagttatgggagctacaattcaagatgggatttgggtggggacacagagccaaatcatatcagctactatttagttggaggaaaaagtgaatcactgcaatttgctgtgacaggcctaaggtcattacaatgcactttcttctaattctttactaccagatcccaagtgtattagtctgttttcacactgttgataaagacatacttgagactgggtaatttatcaggaaaaaggttttaatggacttacagttccacatgactggggaggcctcacaatcatggtggaaggcaaggaggagcaagtcacgtgttacatggatggcagtaggcagagagcttgtgcagggaatctcttccttacagaaccatcagatttcatgagaattattcattctcacgagaacagcatgggaaatacctgcccccatgattcagttacctcccaccagatccttcccacaacaagcgggaattcaagatgagatttgggtggggacacagccaaaccatatcatcaaacttcttgtagaaattattttaaccttcttgtagactttttaaaatctatgtttgtttgagatcacttttttcatgaagattaacaaaatcttgttcaaaatatgaacaaaagaagtatttattataagatacagatgagagtaaaaaaattgagaaccttgaaaaatatatatatatataattttactagtgtgaaaggaaaatatcttggctccccaaatcactaagctaaagggaaaattcaagctgggaactgcttagggcaaacctgctacccattctattcaaagtcagccctctgttcacttaataaatgtatttctgattgcctcctttggaaaggctaatcagaaactcaaaagaatgcaaccgtgtgtctctcacctacctgtgacctggaaaccccctccctgcatgagttgtcctacttgggttgtcctgcctttccgagggaacaaatgttcattttacatatgttgattgatgtctcatgtctccctaaaatgtataaaactaagctgtgctctgatcaccttggccacatgtcatcaggaccttctgaggctgtgtcttgggcaggcatcctcaaccttggcaaaataaactttctaaattaactaagacctgtctcaaattttcagggtttacactagaaaagtgaatttgttgatgttaaacattaggtaggatttaaattcattatttttataaaagtttcccaaaaggggcatttagcaaatactcaaggctgatatgtactgataatattttctacatgatcacaaagctagggagatatttctgagatcctattgaggcaagatagagacagtcaaggaagtaaccatgttcccaggatgtgagaccatggcaaccatacagtaaacacaataagcctcagcatttgcattgtagtcaagctcattaaagcaaaacgatctccagtagggaatttcccctgcagaaagcatgtgcgttttgtttttacctgtcttcagactaacctttgctctttatatgattaaaaaacacagcccagggtggagatttctgatgctaatgagacatctgatgtatgaacaagcatgtacagctactgtgcatgtgcacccagaggaccacccagaacatgcttactagtaatacctttttcaccccttatgaataattatgtaagactcccataaacggagtcttcctagtgccagtctttgctgtctcatacttatgagcggcccaccctgaatcctctctgtctctcagggtgtactgtttattctgcagttaactttcaaaatattatttttcctttgtagtaaattgttctatgctgcacctcttttgctgtttgtcttttgtttaaattcttttaaactaagaagatgagaacaaaggtctcacaacagccatcaacactatagttcagatattttcaatggtttagcagctcttgtgttgcaacttctcagtgtaaaataaatctaaggacaaaatattaatcatccatttatttgaaaatatttattaggcaactagtttgataagtaatttacaaatcaagtggtagagattatagatatataaatatctgcctggcatttacaacatagttgaacattcatgaaagttataaaagaagtacaagaatatttattgtgttatggtgaactttatatgtgaacgtgacagaactgcaatgtacccatatatttggctaaacgttattctgcatgtgtctgtggggatgtttctgaatttctgaatgagattaacattcgaatgagtaaagcagattgccttttccactgttctattgaatgtatgacttgaatcaaaaaagggtcagagagaattttctctctctacctggctgttttcaagcctaggtattggttttctgcatttggactgaaactgtcatcatcatctttcctcatacccaggcccttagactcagactgttactacaccatcagttctcctcggtctttagtttgcagaaagatttggggacttcttagcacttcatcatcacatgagtcaattcattatgataaataaataaataaactataaaccactgattccgtttctctgaagaattctgatttacatagagatataatttcttataatgttagaattaaatcatctgtatttttaaaagtgtgaattcttattcctgagcaaaatattttatttcatttttaatgaacacaaaataattgtgcatatttttgaggcatgtagtgatgtttagatacatgtaatttatggtgatcagataaaggtaattagcatatctgtcatttcaaacatttatcctttttttgttgttgggaacatttcatatatttcttctagctatttgaatctgtatattttatttaacatagtcatcctatagtactgtacaatatagtacagtactaaaatctcccttttgtgtgtgtgtgtgtgtgtgtgtgtgtgtgtgtgtgtgtgtgtgtgtgtgtttaaagttttcctggagaggaattctcactgtttttgtttttctgaaatccttttcacttaccttcattttggaaggttatctttattgggtacagagttttagtttggctgttattttatttgattacttgaaagtagaccttctattatactcggacaatcatatttgtctcagatttttcatttcttgtagtcttagccatcttttaaaaaggtggattattcattttagccaggctatctagtcatgtctttggtcaaacatgtctgttcatgaacaaaaaaacaggagtagaattagtataaatgagtaaagtgaaatgattacagcttgactttttttcttattttctgttctaagtatctacactgaataacactaaataaggtcttcaaataataaaaaaaggaaaaatatatgtaatttacttattttattttagagacaaggtcttgctgtgtttcccaggatgacctcaaactcctggtctcaaatgatctgccctcccatctcagcctcccaagtagctgggactacaggtgtgcaccactgcacctggctaaaataatatactttcagttaatatattcacaactcgcttttttctttttttggtatgtgaaagaaactaatttttctcttaacaagtaaaatgtgcttgggaaactgtataaatagcaaaactatataaatagcaacttttccccaccattatgctggtcttaatgtgaaatgcctatagtaaaataccaagcagaaaaattgagtagattattgcaaacaacttagcactttcatcattgcagttgatacaaaagtgaatcaagaactcttaattgtggaagacaagaaattgtcctgtaggtgagtagcaatgactaatggtgatatatatctcgggaaacagacattttgaattatttctatttccagttttgttaggaaaatctattaaacctcttccataagagagatcctttcagactacacagctggtgtttcagcagaagctgctgttagtgagtttacagtaaaggagaatactcctacttaaacactccagcattcccaaatccaactcggaccatcctgctagaaaatctctccagcagaataccctatcttagtaaatggctatcacagtgttttagatgcttaagtaaaagtaaaaaatcttggagtctaacttgactcttttctttttcttatgctttccatctaatgcattaattaatcatatcaccatgtgtctttattggatattagtgttgaagacctttgtgatatattttgtagattagaataagtaaatcgtctttgcagctggagcctgaataggaatcttttgtaatttagtatgatatcacttgatggtgtatttaaataatacttttctttttcagggaggtgaattagttaatttattttgctaaaggttgcaatatccatctgctaaatacatatagaagccctgactgtttataataaatgtgcaattatatgtcatagcccatataaaaagtctatgctgttctgaaaacattttaattggttcttgtcttaattcagaaaaataacttgggatttcccagagccataaaagtattgggtctggaataagcaatttgtttctcaaataagacatatagtttaatttccctctgaatttcagcttcattaaagcaagttctcaatctctgagatgtcttataattattgttcaattcatttcatttttttgtgcttatcactaacggaagtaacttctcatttgcacttacaatgtatttatttcacaggatgtgaacagtttgattttgcattgtctttaaggtttcttaactttgggtaggttacattttctagtggactgtatttcacttctaagacatgtaacattcaaagaaaaaatatctacatttttgaaaccttaaattgagaaaattgtatttcttaatatgtaaaaagaaaatttgaaaggtgtacaatagttctatgattaacataattgtgaaacaaccaacatgatacaaaaattattgggtcttggtttatttgtttagaggaggaatgggaacatgtacaaactagatgagaaattaatgcttctcttcttatacagcatatgaagatcattagtatatcactatatgccattgctattgccagtgaaattatattttattgtctgtgaccaagaataccacaattaaaatgataattttaaagacaggaatctcaaattcatagatgatttctaaactcagattacttgtctccaagctgaaaatgttttaatgatcttaggaaaaaactacggcattccttcagaatatatgcaaaagaacaacaaaatgaaagttatggaaagatgtttgacacatggacatgtctattgatttcaaaattcacttaatagatgccacaaaggcagggaattaacaatcacaaaggagaaaagaaagaaaatatgtaacataaaaaatatcctgagctgagaaaagatgtgaacttttgaattaaaagtccacactgaatgccaagtgggaataatcattttttagatttccaccaagacaaattcggataaaattttagaattttagaattttaagtaaaaaagggaaactctaaaatcatttgtagggaacataaaatacagaaaatagtgtatatatgtaatttatatgtaaatactatgctattatatatattctctgtatatatcatatttgtattcatatttgtataatgtttatatttatcatctataaatttgagatccttgtctttaaaattattttaactgtggtattactggtcacaggtcactgctgtatgtatcctagggacttggtgccctgtgtcccagccactctatccatggctgaaaagggcctaggtacagctcaggctgtggcttcagtgaatgtaagccccaagccttggtagcttccatgtggtattgagcctatgggtgcacagaaatcaagaattgaggtttgggaacttccgcctagatttcagaggatgtattgaaatgcctggatgaccaggtagaagcttgcctcaggggtggggctctcatggagaacctcagctagagtagtgcagaagggaaatgtgagattgaagcccccacacagaatccccactgggggtcactgcctggtggagctgggagaagagggccatagtcctccagaccccagaatggtagatacaccaacagcttgcactgtgcacttggaaaagccacagacgcccaacaccagcccatgaaagcagccaggagggaggctgtaccctgcaaagccacaggggcagagctacccaaaactatgggaacccacatcttgcatcagtgtgacctggatgtgagatatggagttgaaggagatcattttggagctttaagatttgactgccacacaggattttggacttgtttgggtcctttagaccttttgttttggccagtttttctcatttggaatgggtgtatttatccaatgcctgtaggtctattgtatctaggaagtaagtagcttttgattttacggactcataggtgaaagggacttgccttgtctcagatgagactttggactgtggacttttgagttaatgctgaaataagttaagactttggggaactgttgggaaggcatgattggtttttaaatgtgagggcatgatatttgggaggggacggggcagaaagatagggtttggctatgtccccacccaaatttcatcttgaattgcagttcacataattcccacgtgttgtgggagggacctggtggaagataattgaattataggggagttttccccatgctttctcttggtagtgaataagtttcacaagctctgatggttttataaagggaaacccctctcacttggctctcattttctcttgtctgcaaccatgtaagacatgcctttagcctttcatcatgattgtgagccctgtccagccacctggaactgtgagtccattaagacaccttttcttcataaattccccagtcttggatatgtaaatatttaccagctgcatgcgctcggctaatacaactaatacatctcccactctcctacacccattccatctactaccacttttctcacaggaatgttaataccaagttttcctggggtgacaaacactgttgggctgggttctgaagagccaactttcttggccaagctgaataagatggggagacagaattatttaaatatattggccagaagcaaaataggaccacaaattcacaaagtaaagagagtatcagcaggaactacgtagaacacctgtgaaggtccagtctaatgaacatgaaaatggttggtgtgtgtaaatcaccctttcgttcagttgagtatatgagtaggcatagcttaaatgattggaggaggtgtggttatctctttagttttccatattctgttacttctatctggaaataatcttcttctacatctacttgacccatgctttttattgtagctttgttttacgttttttatctcttgtaaccatttccaaatctttctggaaatttccttcaagagcactgttgttcatacccagttttacttctgctcccatcatattttattcattcctatactatagcacttactatacaatattgtagatattgattttctttcatgacttttcaagtgcattgagaatgccctaattgcaaagactatgtcttcttcatttctgcatctcaagcagtaactcaacacctggtatatcctaggaaattaacgagttgattgaatgtctaattaatgaaaccaatagagccctcatttatacaaaagtattatcatttgcaaaattatattgtgtatcaaatacaactgtgaaagattatcttttttgaatgcctctttccttttaatttaaaacttacttatcaattatatcacttttaaattttgtttccactaaatttaaaaaatatatactattttatttgattcattattgggtcaaattttcttcagttatagagaaaatggggatggatttccccaaatatgtgctgactcttgggaaaaactgccgagccaaaatgtgtctacatgaaagttgctgactctacagaggtatgtatattggcagagactgatctacttgaaaatctcttccatataaaccctacattgattcttcctgttctagtaataaaaatgaaagtgatagttctcaaaatataaaaaagagctgtttttaaggaccaaagtgaatattttagcaagactttgaattatagtcaattatagcaaataacattattataattaataattaaaactttccagtatgtgagataatgcatatgttaaacagatttagctattttgcaacatatattatttcaaaacaatatgttatacatataaatatgtaaaattagtatttgtcaataaatgttaaagatgtaaaccaaaggaaaaaacatttctcatttatttatttggcctctatgttacttatggtaacatatatatgtatgtaaaatatgtattttaccattatacacacatgtgtgtgtatatataattttataaaaatagtataaacacaactccagtagatattatatgcatggcttaaattttatgattaaagtagaatattcccaaatatggcatccagaaatttccttggaatgaatagatagctgaacaaaatcttaatttgtacatcttgtttgaaagcacttttaaaacaatgtagtcagtaatattttattagcgctatcctaagtaactgaattatgaccagttatatattgatcttctatcctgaaatcctgctgaacttacagtataggtagttgtgtgtgtatgtgatttgataagggtggggttgcgtggatccccttagggttttctatataaaagatcatgtcatttgtgaataaaaacagaatgctttacttcttcctttccaacctggatgccttcgatttccttttcttgcctagttgtactgactggaaactccagtgcaatactaaataaaattggtaaaagtgggcatcctagccttcttcctaatatgagagagaaagctgtcagtctttcacattaaatatgatactggcctacatttttgatagatgccctttatcaattttagaaaattcccttttatttccagttttccatgacagtttatcatgaaagtgtgacagatttttgtcaaatactttcctgtgtctgttgagatgatcatgtggttcttgccctttattctaccaaaatggctatcaaaagacaaaattacaacaaatttagtttaagtatttcagttggccttgtttttaattctggaagcaccaaaacttcattccataaaatagaataagtgtttcaatgagctgaaccaaaagggttggctctttagacagggaagaactgaagaaagcagaagcaaagaacaaagagcattttattcctttcaaagatgcttttctggtaaggcagggacaggtggacagaacaatagaaaataactgattagtcaacatcaggttacttaaagctaccatttttgtgtaaggattagaacacagggaacttcattgttatgcccattgaagtatttaaactggtctgttcaggaaattggctatttctcctgatttctttgatggccagacaacttagtttgggttgcgtgactgtcctttgctttttagtctggtctgttacagcctaatataggcacttcgtccaaaacaatggcctcctatattttttaaacatggtgtattacatatattgatatttttggatcttaaattgaccttacataaccataagaaatctcagttggccatggtgtagaatcttttttatgtgttacttagctaatatttcattgagaatttttgtatctgtgtttttattttcatgtaacatcttagtctgccttttgtatcagggtaatactggccttctggaataatttggtaagtattcctcgcttcctctctctttctgggagaacatgtgaagaaatagtattatttcatctctaattttttgtaaactttaccaaaaaagtgtctgggcttgggcttatctttatgagacagttctaagttactaattcaattttttatgtcgtctgtttattataggtttgaaaggtgataaggagcatatgccagaatataaatcaatttaccacttccttctttgataaagttttgccattaaaaaatgctttaaagtcataaaatagttggtttacaatctagtacattttccttatattatcaatgacagtatcaaatattttgtggattagtacctgtccatgaactactgtttgatagcaatggtctaaatcactacctaaactatgaagatagaattagtcaaggtacttgggcagcaacttgatagcctaaactacctaacacgtaaggaaagatttattatgttattgtaggaaagttaaaactttctctctgacaagttgataattgagtctgctgaagtaaactgacaatagacagatcaacaggagaaaaacactctctcatgtgaatgggagtcacacaaagtatgaaaactcaaagatgggccagatgattgaagattaaataccctcttcataggaaagagggaagtggggaatgtaggcaattttagaggaagagtaaataatttttaggggagataaataggcccaaagaacagataatagcctggaacaaaatttctatggctctgtgtgtggtgtcaactctagacttccttcctgagagttaatcttctgtttggtgagattataagggcgggacccaagacaattgcatttattctggaggaattttccttagccagataagggaattttaggaaaagctcctctctgtgcttcaggagaggcagaggggcaaaacatgagaagcgggtgtgggagaaggtcagagagaccttggttctgaggctgtttcctttgtgcaaagtacagttgatccttaaacaacacaatgttgaatggcaagggtccttgtatatgcagattttttaaaaataaaaattacaccaagtatatctgcctcttctgcctcacttctacctcgtctacctcttccacctctgagacagcaatacctaccccccttctttctcttcctcatccttagcctactcaacctaaagatgatgaggataatctacttccacttaatacatagtaaacatattttctctttttgatgtttttcttaataacatctttattttctctagcttacttataagaatgttgtatataatacatataacatacaaaatgtgtggtaattgttcatattatggggaaggcttctggtcaacagtaggctattagtagtcaaattttaggggattcgaaatgtatgtgtgaatttttcactgtgtgggtggctagtgcccataagtcctccattgttcaagagtgagttgtactcaacaagtcaaagcaccatactttggggtatcattttgctgagccccaacattttgctggagaatatcatggaacctaaggatagggaaatggccaggtctaaggcagcatctgtggcaatgaactggaaagtctttttgacaactaataaaagacattttctctataatcttatttttttacactaatcaactttgcatcttttacatagtagaatgcaactacttagaattctctgattacatattttgatctttgatctcatcctaccgtggatgtctatctgtttctataatgatcacttgtaaggggtcatgggcatatagtacaaacatcatgttttggggaccctaactacagggatggaaaaggcatgcagcagagaacatggtctggcagaagctaccaaagtgtctcctatttatactttaatatgatgtaccttaaaactcacttttgggactagcccaaaaaacttgtagcgcattactttaaatgtctccaatttaggtaaatatttcaaggtaaaaattacctttcagacagccatatttaattttgtttgaacttgttatttgaatcaactgggttatcaggctatgcatgtagcctttagaaaaaaaataaaataaggtgagagatccaatattcagtctgatttcctatattggtaataagtcatttgtagagcttaccaaagagtctgaaaacatattgagtaatggagaaatgcataaacgcctaagtacatcatttaaaaaaataacatttattcaaatatacgtagtcttatttggaaatcttagtaatttactctcactaatgtttatcatatattatatggaggcagttccagaccaaagacagtagatgtgaagaaatagtactcaattaacaaaggggagacttggtttaaaaaaaaatgtgtgtgcgtgtatgtgcgtgtatatgtgtatatgcatacatacacatatatatacaaataaatacatgtaaatacgtgtgtgcatataaaatacaatatatttcatatgtgtaacctcgctagcataacaaagtcttatcactcaggaaattccaagggatttagcagctctgtgccaggaacgagggataaagaccaagtgtctttttaattgtagcacaaaaggctattataattcttatccttgtttctctataagtaaggtgtattttcctttggcttcttgtaagaatttgttttttctttgttatttttctgcagttttaatgacacgcccacctgtggggtttttggtttttattcggcttgatgttctctgaacttgctgcatctgtgacttggtgtctaccactaatttttaaaagttcttggccattactatttcaaatatttcttcctctccgtttcttctgtttttttgtttgtttgtttcttcttctgatattatgttcacacatatattacatcctctgaaattattgtgaatattcatattcatttttttttcaattccttttctctttgcctttcagtttaggaagcttctattaagttaccttcaagctcactgcttatttccttggctgtgttatgtctactgatgaacccaagaaaggtattctttatttttattgcagttctagagtcttcaaattcctttagtgtctttgtttttagctatgctcttgactttgggcttttcctaagtacctcttctagatagtctgtatgttacagctagttcagctttagaacccacagctatcatatgaaagcaccgttggtatggtaaaatagtgtggtagaatgggagccttccataagctgattaaaactcgatcttttgggaggcctgtgtctcagggttgtaaacttcacaagtgtttctccagtgataaagctttttcctcttataattaaatcattgtaccatggccctatttatatctttttttgctgtctataatggaaataaaaaccaagacagtgcttattttttcatatatttataggttcagataactaaatgcatgcaaattttgcacactctaagtggctatggtacactgtcagtgagcaacatctattttattggtgtgttaagcagaaaaactgtagtatgaaaagataatacaaatatcctgctaatatctttatttcaataaattgaaattaatatgaatgtaaaaagtgaataaagacacacacacacacacacacacacatttaaactagatttattcacatgagaaaaaagaacagatttccaagtttgaccctagaggttttagatacttgtgtaataggcatatgatctagtgttctttttcttctgtttaagagtctttgaattaattcacatttgaaaaggccagaagagaatgaatcttatttatttatgatatgtcttagtggaaaacttcatgttcatattaaaaaaagtactaagaggaaagtaatttcagatgctgaacaatcagcaatttaagcaaaatctgtcaaaaccagatgttgttttgacaatccattctaaatagacttgttttgcattcctatctctggtttcaaaataacagtacaccaaaacaatgtagtcttctgtaaaagagattctgttttagtgcgtaatgttggaacaaaacttgttgagggtgggtggatgaaataggatgattccattgccaatgaattgaattagagtgaatttatttattattaacatccaacataattatcataattatttcaaaagtaggtaaacaatagttgtatttttaaattttatttctaaaagactttttggagggcaatgctttttttgtttgaaaactggccactctgtattcttaatttttgtatgtttaaaaagcctggaccctttattttatttttcaaaataaattctatactgtactatttactctattaaaaaagcttaggcagataatttaaacaatgcatgcattctattagtaacaaaagaaaaaggataagaacgaatagctttctgtgtgcaaagcaggaatctgaatggttataatttactggggtacaaatcattttgaaggaaataaacatcacagtgttgtccaggttagctgagaattaattttgataagtgaagagaacccaacagagtagaaaaggaagtgttgctaaggaaagatccagcagtctgcagttagaagggcaagtcttggaagtgacagtgttcctttgagtggaagagcaggctaacttaacaagggacttttacacttgcagtaagtgcaattctgtctagcaggttgataattaaacttaacagcaagtcacaaatatgattctttccttctcaggttatagacagtgagatgatgacttagatgcttataactagaataacactaaaataaatcagattctttagaacaatatgtaaagataattgtgaagaaattaagatttttatacaggttcaatggataaaactcaaaatcatagtttagtgaaaaaaaaaaaacaaaactcatagcttagtagagtaatttgaagaatttttttatctgtccattggagaagtattactccaaatgctacttatatatcaattttagctatttaagttatcctgccatattttaatgaatattttgtcattaaataataggtggttggtgatactgccatttgtgaaattcagttagttttatctgccttccaagtacagcttttatcttttattggacttagttgtattttacaacatttattagataaaatcccagctatttgacaagctctggaatttgaattcaaacaaacatacattatgtcctacataatttattaagctaattcaatgatataactgttgatttataacacgtttgaaactggagttttcatatatttgccaactcagagttagcagacagtttctgtgtttgcttacagaaatgtgaaatagccctataggtttgcaacggaatgatgattatcttcagctatctaaataccaaactgcagtttttgcttatttcggtagtgtaaatccaattccaagctatcaatgagtcatcattgaacccagagttgggaaggaatttgattaatggagatagtcagtggtgtgctgaagccaccacctttcagcttttgacaactgattgttaaattttcaggaagtttgtgagctgttacacggtactttttccttacatcaacaacaaataaatccaagaacgtagataactgttaaatgtagtaaaataattatgaaatgatggttttgactatgtatttcaattttagtataatttatttaattgtaaggttatataacttatttatttatttatttatttttttgaaatggagtcttgctctgtcgcccaggctggagtgcagtggcgcgatctccgctcactgcaagctccgcctcccaggttcatgccattctcctgcctcagcctcccgagtagctgggactacaggcgcccaccaccaggcccggctaatttttttgtatttttagtagagacggggtttcactgtgttagccagaatggtcttgatctcctgacctcgtgatccgcccgcctgcctcggcctcccaaagtgctggggattacaggcttattttaaaaataatagttgtgtttaacaaactggcttacaaagttttttaacaatcagcacaccactcactggctatctccattaatcaggaagcttcctcaccctttcctttccttccataaacacgctgtggttagcttgaaatttgcccagaatatctcctcaaataatcatctgactcaataatgacctcttcattttgctattcccagtaattcataattgattttaataatgtttgagcaaccaggatgtgctgatattgtatgaaaccagcacagtcacacgtattaactaattagagttactggatgatttagacagctggttttcctgaataatcagctcattagagattgatactttgccaatagatgctttaagaaggtatgtcttggagctaccattttggttaatatatagctcactatgtacatttaggtcaattgaattacttgatcttgatcaaagacaaaaagaaacccaatactttagttcataggaaaaagccaatcatctgcagagggatgggttctgttcttatgctctagtttatttatttaatttgattttttggaattctccaaataatacaatctcccacagcagtttggctaataactcgctgcctcagctaaataatggtgtcagagtctatgagttataatgtaacattaaggagtgtaatgacagttattctccagaggatgtttcaaaatcacaatgaagtaacaagcaatttgtagaggatccatccctgccagttgtcaaagcattagcattccatctgccagacagttggattagcatatccctagtgaagttgttaaggcatctttaaaaagactaaatcagtactttgtaaaatctttaggaagccatgttgaagactgcatgaacatatttctttagatgtatgttagcctttcccccactcttgactacttattatcatttgttttagcttctgctaaatgataaatggccgagttagaaaccagaacatttttctccacttgagcaattgaaagcaatattgtattttatttatccttcttagaaatagcctgagaattggtattgttataaatatatatgtatttttttacaaaactgaaagcatttttgaaaaaatagggggatacgtagttcatgccatttctgggcttgaatgtttacaatgcctgatgctttcatcatactccactgacagctgtgatctttgaaagttatttgcaacgtgtgctgagaaatgtacttcctatgttttgtttgcagttttttattttttctgcaaatgtttttgaaattctttctaacatttaaaacacacttgagattaaggtaagaagactttatctcactgttgagaaactttgtgaaaattcaggctgctaaaatagtccaggtctacttacacattggggaaatttattcaccatagaaggggccactgaacaatcataggtcactgtgcaactgacatcacgggcctatgaacaaactgatgacattgacagagtgatgctacatgtggactaaacagtattgattcccactgatctacctcccgttgactataaagttgatctaactcctgatgcttctgaatgtccaatctttcaacacaaaaaacaacaccgagctctaaatatggcacttctaggagtcactatttatatcgcacactgcaccagaagcagaattgtagatcatttgaatcgcctaataaagaatgagcaaaagtgccagttctgagataatattctctaaggatttgagaattttgcagtgatttgataaaatcaactgcatagcttactatccatattaacatgactttagtattgtgctatcttcatcaatttaactttataattcctgaaaacgcttgcccaggatgagaaaaatgataaatttctttgctgttaatttcatgaattttctcaaggactcattaattcttccacagaaaagcatcaaacaacaatttatactccatgactctttggactccttgcctgatcatcctctccttgctgtgtctactgcttataaaccattatttcatgattgttacccaatcctaaccaagtccccatgttgaaagaactgtcttaaaagtgacttcacaatttcaatgtctagactttgtgttctctcctctgggatgttactaagattttgttaaggtagttctcttaagtatgatgagcaataaactcagcttaatatttttaataggtttctttgttgatgtttcgagagccgcattcaacagatgtttgactatggaaactctaaatatacttcataataaaatttatacactatatatacatttcttatactttccctaaatttttcttcctagtctataattaggcatgtgttaggtatgaaatatatatatgaatgaatctcaggtcccagtgtttgtgtagatgcgggttctgattttgccagcttccttggcagactctatttgctctaggaggtgctactgagataaaaagctttggttatatttacaatggcacatctaaaacaatctgaacgtatgtagaaaataaaaataaacaaaaataacagatgtcagacacagctttcctaggaatagtgatagaatgcctgcattagtcactgtctaatagctttgctctttaaagataagcggctttcttttgccatgtacaacaacttcccaatttgtatttaattttaacaaaaatcagtgacaaagcgtggtatgaatttggtacattagctatgaagaattctaggcagcttgttctcttaatctgaaatgaggtcatttctgctaggcttgttcatttatgtactgctgtgactgcactttgtacctctgaggaagtcctcaaagatatgaccttccattcttttggcagattccactcagtagtgagaaatgaagaattacttagtaaatggttctgatcaacagcctttgtctcaacattttttattttttaaacctaggcagggatatattttaataatattgaataaaccattttttaatttcatatggaaagaacttcaattatagttatcaaaatagcatatttaagttcattgaattagtaatgtataaaaggaaaagccaatattttatacataatgaattaggtaaactaaaatcaaaataacacaaagcaaatgtgttttttcttctgatattataccactgtatattaaattaagaaaatagaatgaaagaaaatttaaggacagaggtgtgacattttttacgataggctgttattatatttgtcattttatagcctaggccacctcttctccaaatatggttcctggatgagcagattcaacaccacctgggaacctgtttgagacaaattctcaggctccaccccaaacctactgaattagaaattttgagaataggacccagctaactgatttaaccagccctcagtatgattctgatatatactagtctatatactagtctttaaagcttatgttatacaagtgctgatcaatcaataactatttggtaatgatttgctcagacactaaaaaaaatgtgtgtatatatttggaaataagagaacaatgtatcgaaatataaatgtaagtattgctacactgagtgcccccatcttcctcatctgaaacatgtaaaattaaataatgtcctagatttcttccattttgaagaatttgtaattttataactgaataatcaaaatattataaacataatttatggaaaaatctgtgaagaatttaacatgaaatgctgaatctttgtggggagaggttgaatcaggatcttatgaaagagcaaactttgagtacatttattgaaaaggggtgcattcttgttgggaagcccattgccgaagcaaggagcagatgaccagttctcttgcacagagttctaggacacagtggaagagtaaggtgcggttatcaggtcctgaaggctgactgagaagtgtgcacttgtttcagaaatccatggagttttcaagcaaatgagtggaaaggaatagtgtttattttattttttttccaacactggctctgataaatatgattgattgaagaaggaaaatggtggaagtttgtaaaacaaagcaggctagagataataaagccctaagcacagttattttaataagaactgagaagtggaaaagcaaagagagaaatgaaaatgcctaaggtgttttgatgatgagtgtctaggagaggggagacttggtggttatgtgtgtggtccccttggctcctactggtttttggatttatttgttataatctggaagggaaatggatgtgattcaaaatattggttgaaagatgtagtatataaactatataaattgttgtttgaataatttttatgctgagagattttgaaaaaatacataggcattatttcatggaatatgtactttagtaaccatgataatatataaatgtgctgacactgcagtcagattatagaaatttaactcctagcttggtcgctaaccagctatgtaatcttgggaaaattatttcatcctttttagcctcattttcgatttctcaactttttaacatagtgataatgcctatatcattgggctagggcgaggattataagaaaatcaatttaaaagttaggaaaaagcctggtacataataaacattcaataactgtttacaggtattgataaatagaatgacatccaaataagaggtaattaacagattcttactagcttaatgaaaaagaatcaaagacttcatatataaagtattgcataaaacatcactgatatctgtaattcatttgggaactttaaaatatatgttttcatgaataatgttctgtagatatatgaacatttataaaatatattttgcaaaaattaacttatttttagctaatgttgaacaatgtttataatctcttttagttataatttttctttttcttagatggctttaattttctgagaatatgccttaaggcattgatagggtttaggacatgttactccaaaataatggcatcttggcatatatacagaatattttgagcagaaggaatctgagaaaatggcagaagtagggatgtctctgtgaccttctgctacccttctccccaggccagttttaaaacctaggaaggattttctcaatcttctcctgaagcaaatcgttaagaccctcatgtgaaagatgacttctctacaactagaagaaatgagcatccttatctcaaaagacacagagatacctagaaaaatctgaagatactgcccttactaagttgccccagtttaatgccattacatcatactgtttttgccctatcatagttctccacgactctttattcttcatccagcccactataaaagcactaggtttggctgggcgcggtggctcatgcctgtaatcccaacagtttgggaggcctaggcaggtggatcacctgaggtcaggagttcaagatcagcctggccaacatggtgaaaccctgtctctactaaaaatacaaaaattagctgggcatggtggtgcatgtctgtaatcccagttactagcgggggctgaggcaggaggatcacttgaacctgggggttggatgttgcaatgagccgagattgtgccattgcactccagcctgggcaacaaagtgagactccatctcaaaaaaaaaaaaaaaaaaaaaaaaaagaaagcactaggtttaactctttccttgggtcttcatttccttatgaaggctcccatgtcaggtaaaatttatagtaaataaattcagatgcttttctcttgttaatctgtcttttgttatgtggcctcagccagtagcctaagatggaaaaaagagaggtatttttcctcccctatagcaccatatatattatctaaatatatttagattatctaaatatattatctagatatatatctaaatataatgacttgtatcattaaaaatttttagtttgatttatctccatgttcatactaacactgagttttatttatttttatttttattatttgaaaacaaaacatttattcatttacttgactgctgaatttcatgagaagggattgttcagggagggtcattgggctgaaaacccggacaggagctggtgcgaccgctgttcaaatctgagagtggtggagatggagccctggggaggagacgttgctgccttttaagtctgagagtcgttgagctggaggtccacagaggagccagtgctgccactgatgtcttaggttgtggagctgaagaccaatgaaggagctggtgttgctgttcttctgttagggtcatggagctggagatccagcggggagaggtgttctaattggagcgtcgtgcaactggagacccgggaggagctgatgttgttttaattggagggtcatggagccgaagacctggggaggagctggtatttttctagtttgagggtcttgcagctgaagacctgggaaggagctggtgttttttgtttgagggttgtgcagctgcagaccctgggagtagctggtgaatttctagtatgagtgtcttgcagctgaagacccggagaggagctggtgttctattttgagggtcgtgcagctgaagactcagggaggagctgatgttctagtttgagggtcattcagctggagacccagagagcagctggtgttgttctagtttgaggtttgtgcagctggagacctggggaggagcaggtgtttttcagtttgaggatcatgcagctgtagaacccgggaggagctggcgtttttctcgtattgacttgttgttctagtttgaggttcatgcagctggagacctggggaagagcgggtgtttttcagtttgagggtcatgcagctgtagaacccgggaggagctggcgtttttctagtatgagtgtcctgcagctgaagacccggagaggagctgttgtactagtttgaggttcatgcagctggagaccggcagatgagctggtgtttctttagtttgagagttgtgcagccgtagaacctgggtggagtggatgttgttctagtttgggggtcttgcagctggagacccagagaggagctggtgctgttctagtatgaggttcgtgcagctagagacctgggaaggagcaggagttttttttagtttgagggatgtgcagctgtagaacctggaggacctggcgttttttaatttgagtgtcctgcagctggagaaccggaaaggagttgatgttctaatttgagggtcgtgcagctgcagactcggggaggagctgatgtggtagtttgagggccctgcagctggagacccagagaggagctgatgttctagtttgagggtcgtgcagctgcagactcggggaggagctgatgtggtagtttgagggccctgcagctggagacccagagaggagctgatgttctagtttgagggtcgtgcagctgaagactcggggaggaactgatgttgttctcatttaagggtctctcagctggagacctggagaggagctgatgttgttccagtttgagggtcatggagctggagagccagagaggagctggtgttgttctaatttgaggttcatgcagctggagacccagagaggagctggtgtttctttagtttgagggtcgtgcagctgtagaacccaggaggagctggtgtttttctagtatgagtgtcctgctgctggaaacctggagaggagctgatgttgtagtttgaggttcgtgcagctggagacccagagaggagctggtgtttctttagttagagggttgtgcagctgtagaacccaggaggagctggcgtttttctagtatgagtgttgtgcagctggagacccggagaggagctgatgttctagtttgagggtcatccagctggacacctggagaggagctgatgttctcgtttgagggtcatggagctggagacccagagaggagctggtgttgttctagttggaggttcgtgcagctggagacccagagaggagctggtgtttcattagtttgagggtcacgcagctgtagaacccgggaggagctggtgtttttctagtataagtgtcctgcagctggagacctggaaaggagctgatgttctattttgggggttatgcagcttgagacccggggaggagatgatgttgttctgttttaagggtcatggagctggagaccaaggggggagctggtgttattcttgtttgagggtcatggagctggatacccagagaggagttggtggtgttctagtttgaggttagttcagctgaagccctaggcaggagagggtgttttttagtttcagagtcatgtagctgtagaacttgggaggagctggagtttttctagtctgagtgtcgtgcagctggagactcggagaggagctgatgttctagtttgagggtcctgaagctggagactcaggtaggagctgatgtttttctgatcagagtgtagtggagctggacacccagggagaagctagcgttattctagtttgaggttccttgagctggaaacccagggaggagcttatgttgttctagtttgagggtcttgcaggttgagacctggggaggagctggtgtttttctagtctgaggttcgttcagctgtagaccctgtgaggaacaggtgttttttttacttggagggtcatgcagctgtagaacccggaggagctggcgtctttctagtgtgagggtcgtgcagctggagacccggagaggagctggtgttctagtttgagagttgtgcatctgaagactcggggacaagctgatgttctagtttgacggtcatgcagctggacaccttgggaggagctgatgttctagtttgagggtcatgcagctgaagacttggggaggagctgatgttctagtttgatggtcgtgcagctggagacctgggaaggagctgatgttattctagtttgagggtcatggagctggagaccctgggaggagctgatgtttttctagtttgaggctcctgtatctggagactcaggtaggagccgatgtttttctgatcagagggtcttggtgctggagacacagggaggagctgatgttttcctagttcgagggtcgtggaactggagacctggggaggagctgatgtttttctgatcagagggtcatggagctggagatacaaggaggagctgatgttttcctacttcaagggtcatggagctggagacccagggagaagctggtgctgctcttgtttaagtctgaaggtcatagagctggagacccagggagaagctggtgctgctcttgtttaagtctgagggtcatggagctggagatccaaggaggagctgatgttgttttcatttgaaggtcgtggatctgcagacctggagaggagctgacactgttccagcttgagggttgtagagctggagacctgaggaggagctgatgcggctctagtctgagggccatggagctggagatccggggaggagctagtgtttctccagtgagaagtttgtggagctggagacccaggggggagctggtgtccctccaggttgagggttgtgcagctgaccctcaaacgacctcaaactagaaaatcactcctacccctggatttccagctcctccaccctcaaactagaacaacactgcccccacccccgcaccgtatctccagctccatgacccctaaaccaaaaaaacaccagctcctccctggttgtccagccccatgaccctcaaaccagaaaaacacagcccttccctgggtgtccagctccatgatgctcaaaccagaccaaaaccagctccttcccgggtgtccagctgcaggaccctcaaacattgtccgctggtgatttttctggtcttgtagaataaatctgtttgtacatgctcacttttctgatacttctgtctgctttcttaattgctggagcagttctgacatatctacctcatttacttggtgtttccaagcttcaaggaataattattgaaacatattagacctatctccagcattcttaaggcattattcaattctaaatgatgagtgagtggccctatgtcagcaattttctaccggcctttacttcatcttttctggtcccacatcctcaagatcaattgcctagcatgttctacagatttctgctggtacatattagccaggacctagaattcttttagtgtataatttccctcccatagcaggaactatactttacctgagctgtggtgagacttgaatttccttattgggctagaagctgtgagcagtggtggagacaccttaaaggaggccaagaatcatttggcagggccttaacttcaggtgagtccttctcataatagtatgaggctgtgtttctccagcaaggagagtgaaatcttcccatcctgcttagactgtttagggctacctagaggtttaaacacctctcgcatgcatctctacccaaatattctggcctaagggtctcatttatttgttaacacagctttggctttaacacaggagaagccctgctatggctgtaaattaagcttcctttgtggtgtgcgcttgttacaattaagattgtagttttcaacacactcctgtctctagccagaattgataagggtctcctaaagtgccaccaaggacactttctgaaagtcacactataagtcattttgtttgctattctatgtttgttactttccttctttggggcttctatggtgttaacaatcaccaaacaatatcacaatatgcataattagcattcttttaagcactagagctattacataaaccagtgctaaattctacaagtcttctgggttttctaatctaatccatatgagtagttgcattgtataggatgctgtggataattattaacccagttactaacagcaaggagggccttgttgacatttgcacagcaagtgatctaactccagaatctcatccttcaccaacactctttagctgagttccctagaggcatacttcaagaaaaggatttgggccgggtgtggtggctcacgcctgtaacccagcactctgggaggctgaggcgggtggatcacgaggtcaggagattgagactatcctggccaacatggtgaaaccccgtctctactaaaaatgcaaaaattagctgggcatggcggtgcatgcctgtaatcccagctactagggaggctgagacaggagaatcacttaaaccagggagttggaggttgcagcgagccgaaatcgtgctactacactccagcctggcgacagagtgagacttcatcttaaaaaaaaaaaaaagaaaaaagaaaagaaaaggatttgattgcaaattaactgcacgaaaaatcagtaaagaagtgggaagtaagataggagaggaaacaaaattaataaaaggtgctttaactagccaggttatccctgaggcactaaggttcagtcttaaggaaaacccctggtagatggccaagttttctaatccaaatttcaaaaaacctgagacacttatccttcaattcatttctataaatgaatgagtggcaacaactaagggtttaatcgtggtcacttctagccttacacagcgtgtgagttgagaaaaagctctcaggcagagacatctttgacatatatgggaatggaattcctttctgtagctcaggatgccatataagcttcaatcatctgacccttctttgaatctcatgttttgtgggactccagtgcaaacgcatgtaattaaaataattttctcctgttaatctgtcttatgtcaatttaattcataggccaaagaacatagaagggtacacagaagacattttccctctcttacgcaggtacagggaatattgtttgcaatgctcacggacaaaacagaaaaaaagcataatactttcagggcatacaaatagtttgaaatggctagaatgtggagtgataattcgatgaagttttctaaacaggtttcatgtttggtttggtttggtttaatctacaaaataggaataagagtacctaactcttactcttcatgttaaaatttaattaattattaatatgtgaagtacttagaacagctcctggcactatcaagtgtttataaatattaacaattattagcattattatatttctactattatttttagaagattggaagtatgatcaaccacttactacagagtgaggagcagaggcacatgcctcatcagaacaccatacccagtgatattcaggaaagcaatttaaaaacctcctgacccttcttttttttgaggggatagtgtgagtgataggaaaaggaggtcactgctttgtaagtacacatatttgattaatgtaatttgtattttcctgtagtactgcctaagatttatattttgaaatccatattactttattatataaattgcattataattatgtaatatataaatacttttgttttaaatttgatcttatccttttatcaaaatgaatggcttttatatttaccatccagaaataaagaaggtagtctgttgatactgaaaattactgctctaagagggtgatcatcagttttacttgtgagagtttaaagaaattctgaggaccaggtttcctctcctgcagttctgatttataaattctagttgtggcttggggcattgtgactgagacaattaataaagataatctcaacctaattgataagagtaatagtgtgatgcataaaattattgccaatgatttgggtcaaagaaaaattcaaagctttcttaccccttaaaatcagcttgcatgtaaaatcagaaccctcctatattcaatcaatcacaaatataaccaactacttcatggaaactaccaaaaaattaatcaaattcacaaacttttataatttatgctccttcaggaaagaagaacatttcatttgttattgaagctcttttattactgagtaaaatagcttgaagtattaaactggtcactttaataatgaatgattttatgattacattgctctcatagcttaatgcaagaaaaataaattagttacaaatttaaatgctgctatttgtatagtatttgcaaatatttgccttagtaaattaagaaaaaaacagtggtttttatcattactgtatagtagtaaaaagaacaacatgagatggttgaaaagttcagtctgaataagcagttaaaatgtttgattcttggttgacctttagccaaaccacccaaacctttcaagtttccaaacgtcgactgaaattcttataagaacagtctgtgttaggatattctcggcagtttttaatcttgattcttttgaaccaggaaaaagagaaacaaaaagaaatagtgaaaacacagttttattttagcttcatacttctgatatgtttttttcttatcaagtaaagttaaaaaaaggaaaataattgtaagttaaaagcacacacccacatgcaatagtcaggaaatattctggctctatgtactctaagctaatttttatttctcctatttgtttgtgacttttcccccaccagcatatctagaagcagtgacatccttttcccaccattcacactccctccataagaaacagaaggatcaggaggtttttagtttaattcttttcctgaatatcactggctatggtgttctgatgaggagtgtgcctctgtttcttactctgaagtcactgatcatacttccaatcttttaaaaataatatacattatataacaatgataataataattgttaatacttataaatacttgccagtaccaagagctgttataagtgcttcatatattaaaattagttaattatagcatcaacctcaagagttaggtactattattattcctattttgtagatgaaaccaaactaaaccaaacatgagacttgttggaaaacctcatcgaatatcactccacattctagccatttcaaactatttgtatgtccttgaaattatagtttttttgttgtcgttgttatgtttggtgcatgagcattgcaaatgatattccctttgcttgcttttccctgagcacctgactaaatccatgtcaggcatcattttgttcatttcatgttctcttcagattcatttagatgtttattctttgttaaccgaaagttccttgaagatgcttctatcttaatttttttttctgatgatccatgagctttcacagcagagatttcaacttgtatctctacattcctctgcttgagaataggactgtccaatggaatgttttatgataagagaaatgttctatatctgtgctggccaataaactaccccccagccatatggagtttttgggctcttgaaatgtagctagaatgtctgcagaactgaatttttagttttggttagtttgagattaatttaaatagctatgtatggctactgtattggacagtacagatttagaatatagctgacactctttacaggtacacaagcaatgataaatgaatgaatcagtgaatacataagttaacaagttgcaatgaatgtaagtcatctgaataaatgaagacaggcaaaactagaagtagggaggtagtaagaaagctacctcaggtttttgtccatttataccactcacattcataaacacccatcttgtggtagaagtaataataaaaataaaggccaagttaaactagtgatagcaacaaaattttggaaccaccattcccagatcatttgattctactaaaagtgatttcagatcaggggaaaaaggcttcctatgtcttcagcatcagtgttcatgcctgcaggtttttataaagaatttacattagaatttcagataattacttaagttcctttttcatagcataacaactttcaatacattttgtttatatacaatatgattcattctttgtttttagaaataatatcctcaacataagcaactatgaaatgttttatgtaatcaagctcttaaaaaactagagtcttgtatggcatttttattaaagtaaaattattattattatagttatattacttttaatcactatctgtttacatgtttacagaagaataacgcacatagaaataaatcttcaacatgacagttttcaaaacatactctattccttgttttttgccatgctaataatcacttctttcctcaggtaataagaaaatcttaattggagtattaaaagaactacatttgaaaaagtatgaaagataaaatgttaatactcggaaatatttattatacaaatggaaaacatcattataaaacttgatttcgccaggcacggtggctcacgcctgtaatcccagcactttgggaggccgaggcgggcggatcacgaggtcaggacatggagaccatcctggctaacacggtgaaaccctgtctctactaaaaatacaaaaaaattagccaggcgtagtggcgggtgcctgtagtcccagctactcggcaggctgaggcaggagaatggcgtgaacccatgaggcgcagcttgcagtgagcggagatggtgccactgcactccagcctgggcaacagagagagactccgtcacaaaacaaaacaaaacaatacaaaacaaaacaaaaacaatacacttgctttcagtttgtcatcaccccatagcactgtgtgtactaattttccatgttctattcagtttatagaacttacctagcttatgttgcatctttattcatgttatatttgttacaaattattaaccacaagctaatatcaagtcatcaagtataaagcatgaaaaataagcctttagaaattgtgaagttgtttcataccataacagtggtgtttttatgacatttaacataatgtattcatacctttatttctgaaagtttcatgccatttgactaaaccacatttctaaatgtccctggatggctccttcaactcccttgtttgtagtttatggatgactttatctccattgacctataattctgtgcctctccagcaaatcactcatacagcctcacagctggaattctcattacttgatattgctttactgctgctgacaatttaagctcagaattttttgtgtgttcacaatctgctgtcttttcaaccatcttggttttcctagtccacatgttctttaacttcattaagcctccagttttgtgattccttttatttccacagcccactcatcttctttattttatttcctaatctgttcatattccactgatgtactttatctttttcagtgtttcaactcatttttcattacattctcctggcaattgtcttgctttctgtgctcatgcccagagtaatgtatgtgctggagaaaaattgaggaaacatgcacatttatacaaatacaaaataatgtcctctaactttaatctcttcttcaatgatttcttggtatccttttctattttcttagtcaactcttttgcccgttctccttagtgaacgtttgaaattttcttcattctcttaaaacctttaactctccttcagagtgctcagtcagtggtttctacaaataagaggaaataggacttgctcaatgtattaggccattcttgcatcattataaataaatacctgaaactgggtaatttacaaagaaaagaggtttaattggctcatggtgctgcaggctgtacagaaaacatgatgctggcatccgtttggcttctggggaggcctcaggaaacttatggcagaaggtgaaggggtaacaggcacatcaaatggtgaaagcaagagcgagagagggctagcaaggggacacacttctaagcagctaaatcttgcaagaacttaacatcatgaggacagtgccaagagaatggtgctaaaccattcacgagaaatccgcccccacgatccaatcacctcccacaaggcactgccttcaatactggggattatattcaacatgagatttggacggggacacatatctaaactatagcattcatcttcctgatatcactccacaagtatctctataatcatccctttttccttccctcctgttaaaatggcagaagtatccttcaatttgaaagctgctatatcttctacttgtgatctctattctatgttgcctagccgtctcagggagcttaatcctgagtttatcctctcttttttattttcaatctctctctctcttttccccacccctccttcttccatgaaaccaaaaagcttctatctctcaagatactacattgtttgagaccatccttactctttcaatcatcatttactttcccaagtcaatatattttaggccacacctctcctgattctgtgttacgtatctaaaagtcagttggcaactctatgtcacacattgctcaaattttacatgttcaaagatgaatttatgtttctcatcttaggggaaaacatcagatattatatattttctgaattagaaaccagaggcccatccttgcaacctccttttcatttatttgcccattcaatctatcatctctaacatgtcagctctagtgtttaaacaccattaacacctttttagtttagtctttcatcatccctctcttggattattacaagaatactttgtttagccctcctccaatctggttaatgcatttaaaactcactgcttctttctcttcctgcaaaacttcagtggtccctctttcaggattcagcctaaatgctttaaatgattcccaaccttgtatagaatttggcctagactttgcgtcacacctttcacccactatcttagctagctcctttcaacaacttggatttatctgaagccactatcctatctttgatcttgctttgaacatgatatttcagctgcttttcctagctaattcctacctgtattttaaattgtagcttggatgtccttttcccaagaagttttccttgcccattttcccttgtcagctatggttgtgttccacatagctgcttccactatgcactatactagccccattaaagcaattatggcattatataattagtgccttttgagaattttctccactaatctgtaagctctgcaagagcatgaactatgtttatctcattcacaatcatagctccagagccagtacatgttaggcacagagtaattatttgttagataattgaataaaaatgaaggacggaagaaaaatgtgaaactgaagactacccccacaaaaaaggcataatgatatgtcaaaccatctgtgtcccactcacttcctctccagaataaaaagtaaagtgatttggttatctgggaagtagattaggaagtgtaagattacgagaagtgcacattttctttagaatattaaatttatattaactacttactaacctttgttgactggcaaacaagtaaaggtttttgtaccattttaagatcaataagtgttcagatgctgtcaaagcttggtgaagtagatttacaggtgtttgggttacaaagagataacacaatcagtttcctttgtctcaagcttaaattgcggtccaaggatagtctcaaagttcacctccttgaagaaaaacaaaagagatttccttacaagcaaggttatgtaatattttcatccaccagatgggataaatgttgtcacttcatctttcttaccataccttagcgttacaaagtatgaacacataactcacttccatctttggttgttatattgataaatggagagtcatagtgttcaacacgggagcaaacttggtttggtgcactttccaaccttttctctttgttttattaggaaaacattctctttctttcacactggtaaagattcaaagtacttaactgaaatatactgagtctaatatgattaagcagaagtatatggcaaagcaaacatgcacacacacgccaacacaaaacacaaaaacaaaaatatgtatttttcatttcatttttctcttatttctgagaatacatgtattaggcaatattgcattctttcatttctcctttattctcttcttccccttaatttttctgtctttttgtattttaaattattttcttttaggttatatatgatatttcatgacagagaggtggtagtagggacagtttgcaatatcagagccagtcagaagattgcctaccgattttttgtggggaacagacatgataagcctcagaggtgatgctggttacctaagtggtggcaacatggaaccaaccttctttctcccaaagtcacagccatctctcttattttctgtctttccttaaatgccactcatcaatgagatattctctggtcactctacatacaatatcaatctctccatcccccaactctgtattagatttatacacttttgttttcaccatgacttttagagtgatctgaactatacatatattatatactgatgagtttgtttcctgcttttctcagctataatataagctctaggagggcagagaccttgtggtgtctttagttatatactcaggtatataatgaacagctgtttgaatgtagtcattaattaataaatatatgttgacttaatgaataaatgtccttctctgaggctgaaaagattagaaaaaggtaaacttactagagacctacagtattaccaaaaaaaaaagtcagttgtaaggacacagaaatataaaaatctaaaaattacaaatagctttcacaatattatcttcttattctaagttaatttcaaattttgatttcaaaaaagccagacagattttgaatatatttgtacaattaatattggaataattaaaatatggctaattgctatggggaataataaatactacagaaagacatagcctttgccttcagttaagtatatgtatttcaattttactgtcattctactacatgcttagcatttcaaaacttaaaagtagagtttattttatatatatatatatttattgttatgatgatgattatttgagacaaagtctgtctctgttgcccaggctgctctgctcactgcaacctccatctcctgtgttcaagcaattctcctgcctcagactcccaaatagctgggaatacaggcacctgccaccacttctggctaatttttgtatttttagtagagatggagttttgccaggcaggcagatcacgaggtcgagagatggagactatcctggccaacatgatgaaaccctatctcttccaaaaattgcaaaaattagctgggcatggtggtgcatgcctgtagtcctagcaactcaagaggctgaggcagtagagtcacttgaactcaggaggcggaggttgcagtgagccaagattgcgccactgcactctagcttggcgacagaggaagactgtatctcaaaaaaaaaaaaaaaaaaaaaagaaggtgatcttaggaaactacaaaattagtagctgaaccagaagtaagactctaacactaatttttttctctttttcaggctaagtggaataaaaagcttaatgtttaaaacattagtgtaatttatgtctaatgtaaacaatattgtaaacattaagactacaaaaatggcaacattttagcagttaatttttttcaagataaatctaatccaattctagaaattttaggactataatgaacttattactgctttttccttagagctatgtttaacattgtgtcattggtcaacgctgcctttattaagaagtcaaagaataatcatatatgattattcttatttacttacttcagagaactttaagataaaattgcattctttggaatggtagagacaattttcttttttcatttttatttttatttttgagaaataaataaatgcaaagaaacagtcaatgttaggtgtctgacgtttactaacagtaggccttattattcaaaattaatgccagaatatttgtgattctatagcaaagggatattttgaaagatattgttgaaaaacagagtcagtttttttaagttcctcttaatgtctcaacagccagtcacagcaaacttaaaccttaactcaaaaggttgagagaactccaagcatgacataaggaaaatcccttctagccctaagagtttgcaggattggaaaaactgatagagataaggcacagagataacctcccaagttccagctttcccttttcttgtggaagattagagaaatctacattgttatgagaaatcctgagaatgttgaaatgttttgccttgacataacctgggagaagatgcaggcctctaggagaagtctaaggacaatggcagatcattttttaagtgatgatgtgtattaacaacaaccctataaggtataggtagcattattttgcaaataaagtaatggtgaacagtgacttagagcggcttccccaagataatacatatagtcttctggagttgggacttcaaactggaggccattctctaaccataaaaatacacaggctttccagaggaagtgtgatgaagcttctcttaggtgagtagcattagattatcaaaatggtaatgcatttaggtgacatttcagaactgaaatagatataaaccaatttaccaactaaaagagtagaaaagggtagaaaaggatggaggaattactgtgatacggagttccaatgtaatcttgcttcatcatgctaaggttattgctctagtaccatagtgtcttttcagttatgttctagatttcgtacatctaagttgaagaatgtatgttgtaggagttgatcacatgacctcattacagtgggttgctaaaagtcattaaagaatggcttgcagccggctgtggtggctcacgcctgtaatcccaggactttgggagactgaggctggcagatcacaaggtcaggagatcaagaccagcctggccaatatggtgaaaccccgtgtctactaaaaatacaaaaattagttgggcatggtggcgggcgcctgtaatcccagctacttgggaggcagaggcaggagaattgcttgaacccaggaggtagaggttgcagtgagccaagatcgtgccactgcactccagcctgggtgacagagtgacactctgtttcaaaaaaaaaaaaaaaaaagaatggcttgcaaaacctggaaacaataggactaaaggcagaatgccatatacatgaccccctcatagataaaacccgataaactctaaagtgtttttttccagttctgactgcagattataaatattagggctgtttttaaaaaatatgtatgcctaacaccaaaaacacaatccatgaaagaaagaactgataagctggacttcattaaaattaaaaatttatagtctgccaaaggcactgtcaagagaatgaaaagacaacccacacagggagaatatatttgcaaaaggcttatctgataaggactgttatccaaaatatacaaagaactctgaaactcaacaaaaagcaaacaactcacttaaatgtgtgccaaaatctttaatagacacctcaccaaataatgtatgcaagtgacaaaaaggcatatgaaatgatgttccacatcgaaacaacaatgagacataactacacctttattagaatggccaaaatccaaaacatgacaacacaaatcctggcaaggatgtagattaaccagcatttgtattcattgctggtgggaatgcaaaataatgcagctacttaggaaagcagtttggcaatttcttatgaaactaaacatatttttaccatatgatccagcaattacactcctttgtatttacacaaagaagttgaaatctcatgtccacacaaaatcttgcacatgaatgttgatagcaacttatttataattgccaaaacttggaagcaaccaagatgtccttcaataggcgagttgacaaactgtgtaacatccaaacaatgaaattttattcagcattttggaaagagctatcatgccgtgaaaagacatagaagagacttaaatgcatattagtaagtgagagaagccaacccgaaaagacttatacgatgtgattccacttgtataacattttggaaaagaagaaatatgaagatggtaaaatgatcagtggttgtcagggtttaggaaggaggaaagaatgaataggcagagaacagaggattgttagggcagtgaaaattttctgtaatggtggtggatacatgccataatgcatttgtccaaacccatacaatgtcagtgctaagagtgagccctcatttaaaccatggactttgggtgataatgatgtgtcaatgcaagttcatcaaattctaagtgtattactctggtggaggctgctgataatgggtgaagctttgcatgtgttgggagagagggtatatgggaagtctctataccttcatctcaactttgccatgcacccaaaacttctttaaataaagtccttaaaaaatatccagaccccacagtggacaaactgatcagaatatccgaggatggatcctagctgttggtatttttaggtgtcctctggcaactctaatgtagagtcagggttgtacattggaaacagggtggcacgtcttttgacttctactttgttttgagaatgccggtgtgattttcctccatggaatatgaggttgggtagagcagtacatttgtttttcaaatgtaacatgtccttatatgctcttgccctagcaccgctgacacgcttcccctcactctcctcattcccctacaggggtggagtgtaggactatgtgatctgctcatttggctggattctaaaatcatagcatctgtttggacagaaattttgtcagctctgggtaataaaatctaactttggaagaaatttgtattttatttaactattgaccacaaataaaaaataaatttttgttggcaatttccttaaataacctcttcaaatagaacagcttgactggccactggccagtcttacgtgaacttttaaaattactttttacaaacaggaaaaagacagcaagggatttcagtaaatgaaaccaaaactgtcacaacatgataactcagtaccaacgttttcagaaaaaatgcattctttttcctaaaacttttactcttacacaggattttcataatatttatatattttaaaacttttccatccttaattataagcacacatccatatttctaccctgaggtattatttaggaaagtctcttatttgtttttaaaatccacaaactacgacatgccactgttgaaactttattatctgcaagtacataataatatatttatgaagtggttaaatatttttctttataaaaattatacttttttctgtggtgaatttgattttttctataatatagtacctatatatgtggcacatttagacattgtgatgatatgttgagtttgactacagaattgctaaagtgtatttcagttctaaaattgagtagctcagtagaacactgaagtggtgtgagtataacaacactcaagaagatggatggaaaaactgttatgttttcctactcatgatgaagattttaagcattactcaacagtgtagtaattctatcttactgggtttggatttataagttcttacatcaaaatcaaattagatgtgtatttgaaaatgtaattctgacattttaatgtagttgtgtcaacataaataaaagcaaatttaaaactctccttttaaatatgcactgttttgcaaatgtgcaatagctcatgataaaaaaggattttttattttgtgataagattcaaagatcatttaattaatgagctttcctcatgtatccaagtgtttatttttagataattaattgcttgacacagatacttgaagaaaagtaagatttacattttaaatattagatattgtcaactgaatattaatgcagaacaggattcattaattacaataaaaaacacatgtgggaaaccgaatttgatttacaagcattaatttactcacagctttgaagaacattgtcttatacaaaaagaggcgtacctatatactactttaagataaatgttaattactaattcattgaaggactactctttgcatggtattatattatatgtcatggtgattcaaaagtagaaagacagcctcactgcccagatggttacagttcagtaaagaaccaaaaataaaataaccatattatatgtagaatatgaaaacaaaacaaggcaaaattttttaaaaatactctaaagaatgtagaaaatgctgatgatttactatggaaacagtctgtggcacacacatttgattactggcctaataacagttcctggctcccctctgcttcaaccctctgcccctgcttttttttttttttttttttttttgatagatcctcaattgcattaaagtatctcacagctaggagagctccctgtataacgaaattaaaattaaatcatgctaattttctctgcttgttagtgtttgctttaacaacaagtatgtgacttaattctgagcaacgatgtttgagggaaagtgtactggtagattctgaaggatgttcttcatttaagaaaaattcacaatgaaaggatgcaccttattttattttttaacttttgttttaagtttggggatacaagtgcaagtaacaaacttaaaataaaagttaaaaaatacaaccaggtaaacttgtgtcatgggggtttgttgtacagattatatcatcaaccaggtataaggcctcatacctattagttatttttcctgatcctctccctcctcccaccctccatcctccaaaaggccccagtgtttgctgttcccctctatgtgtccatgtgttctcatcattttgctcacacttataaatgagaacatgtgttatttagttttctgttccggtgttcattttctaaggacaatggcctccagctctatacatgtccctgcaaaggacatgatctcattcttttttatggctgcagagtattccatggtgtatatgtaccacattttctttattcagtctatcaatcactgatgggcatttgggtcgattccatgtctttgctattgtgaatactgctgcaatgaacttacgtctgcatgtgtctttacaatagaatgatttatattcctttgggtatatacccagtgatagagttgctgggatgaatggtatttctgtctataggtctttgaggaatcaccacactgtcttccacaatggttgaactaatttacactcccaccaacagtgtataagcattcctttttctccacaaccttgtcagcatctgttattttttgactttttagtaatatgcattctgactggtgtgagatattatttcattgcggttttgatttgaatttgactaatgatcagtgatgttgagattttttttatatgattttctccctctcacttttgggtatttaatttgtgaaactaagatgcctggaaatttatgtcaggcgttatgtcatatgaggttacaaacttgaggataaaaacaatatactgaggagagcagagtaaaaagatgaagaaactagagtttttccagaaatcagtgacccaatcctgtaactttgttgcttctagacttcttgttacatgagataataataatagtaatgatgataatgataataacagcaataatttcccttcccgttaagcacttgtcgattagagattttgtgtttcaatattagaaacaagtgttccgatgctggggaaatgtgacaatatgccctcatattctcattactttgaaacccagaaagccattttaacctattggataaggaaaagtctgtctgataatcccagaaggctaacttaatgtaattttggtgaacacaaatttgacctacttacaactttagagtgttggttagttctttgaggttttgctataactcctacctcataagtgaattctctttataattgacccctcggttttttaggtaagcaattactctgccttctgtattttagcacctgagaaacctgcttagatagagctgctatgatttccattttcactggccacttcacataacaggttgaagctatcaactctgcggatagggctttctcttggtgggtcatttccattaacaggctgttgtcttgtcattcaccctgcaaactcattgcttttcctctcttccacttcctggcaggtccatactctcacactttattttaactggtttgtgacatttctatccccaaatatctggttatctttctcctggctttttaagttttaaaggctcttagggatgagacggtttataggaaagtaaaggttaatgtatttaaaagtaattgtcctgcaggctggcctccttacaaaagagattcgcctcctgtagaactccatggaaaccatttatagctaagagcttaaggcagtcaattttggtcaacaaaaagacgtatacagaatctccatgatcgcatcagaggatcgactggtgttccccatccataaaagctgactggtagagtagggctgttgctaagtgtttgccatgtcttactggttttggatgccagtaacccagtaaccgatcacaacaagggaatggctggtgctcactaattgtgcagctcaagcttaagaattaggctttattttggcagtctgacgtccagcttgttagttcgctgtgtgctcacccaaaatgcaatgaacaacagaagactcacatacttaatactgttccttccctgtgagtttctcctaatcagtattactcctctagtcctcttttgtgagttcttggtcacttgcctttgatttcttgatgttttccaaactgttcactcatttgtagagttggctccagaagaaacagaggtcaatttgcagggaaattatctgatatcctattcagaaatcccttaaatgtctttcctcattaaaaatggcatactttttcctttggttgcactgatgttaaaagccatctgcatctgagtgcaataagtccatccctcttggtgcttattacactcacaagacaagagaaagcaacttgagtagaaggggtggtgcaggttgacctcatattgctcctgcttctgtatcctttgtgctggtatatggccatctctccctaccctggcagctcaggacttcccctcttctttttccctgacttagcttattatattcttttctttccaaatctcttgtaccaaaagagagttctagttatcctctcagaatcctatgttctatttatgactaactagtttggaaattagattatagatagtccaggtgtctgtaaccaaaggtctgattggtatctctaaggcacaatggctcttggattacaacactgattaataaataatctgatcttcctgattttctcagcatacctgcagtgttgtctgagggacactctgccaagccatggtccaaaggtaaaatttgctactgctggcaacttcagtagcagagtaatcttgctgcagcaggtaataaggtaatggcagaggaaggacccgtttaatgcaggcaatgtaggctttccaggttgccaaggaatggccatgacacccatagcaactgaagctcccaggattgctcattagttgaaacacttcaatgtttgaaaaatgtaaaagcttgtgtggcaaacatgtagtgagcaaagagcagaatggcattatctgaggttgggagtacaagcagggtccaagaacattcagtacctgtagatcaagataaaatgtccaaattctatctaaagtaaagtgagagcctttaggaagttttgcagtttggtttcattggatttgactcatttcctacacagggtccaattttatttgcttaaaatgggtgaactagaggatttttttttgaatgatgaactagataaagaggaattgatagtacaaaatagaggggagatcattgtaattgtaaaggaccaaaccctcaaacatgagacgaatgaattgcaagtatatgtagaagcatttgcatctaggaagaggaagcataccttctccatggagacaggaagaaaaaaggagtaggtgggtaaagacagaggtttatttttggaaatagccatgagaagttgaaggatttcccacctgattactttaattttccaaatggcatgtgcaagaaagacaacagaattgaaggatatcactgagattggggattataatttcacaaaaatgccagtctgcctgattttcttaatgcttacctgtgtgcagaaacagtgaaggtgatgtaaacacatacgcagagtttggtttttacagacgagtaatgagagagagaagcaaacaaatgaaatgaaaaatagaaataatggaacataacatggaaaggaagagaaataattacaagatggatctcttgattaggaagttggtgaggtatattgtctggaagtttcagtctagtgaaagaaacatttcttgtgagtatttttgagtaggtaagttgaaatgatagcaaatcatatttgaaaatctagatacaaaaaggtatgattctggaagtggcaagtataacaagtgattaaatttatttctgagaaattaagtgctttcacaaggcagaattgacagttacttaatataaagtttccatcctctgtgctgtcattctcaaatcctctaaggcagggtacagccatattatctgttgggtttcctttcttcatttctgttttaagatttcctttgcctagtttggtgactcacgcccataatcccagcactttgggagactgaggcaagaggacttcttgagcataagagtaggagaccaacttggccaatgtgtgagacaccatctccacaaaaattaaaaaatatcagctgagcagagtagcatgtgcctgtagttctagctacttgggaggttgaggtgagaggatcccttgagcccaggagtttgagtttacagtgagctgtgatcacaccactgcactctagcctgggcaacagcacaagacgctgtctcaaaaaaaaaaaaaaatatatatatatatatattttctgaaaagcagtcctcactcctccccaagaaagtctcaacttctttgaagaaagaatatggtagcctgctttattggaaatgtgccctgacaatagctagccatgattcattcttcacatctggcttgaatgaaagacatttattaaattaaaatattaattatgtagactatttttaatggcatattacatgtgacttagtgttccaggttacatttctaaaatagaatccccccaattttttaaagcaaaagtgtgtacatatgatgccatttttgcatgactcaacttatacgcatgaagatattttgcttactaaagtaagaaataagtaaaatatcttcaagtatataagcttaaaacaaaaaattattgttctaccccacaacaataaaagcatggaatacattaaagtgttaaggtatatattgagaaaaaaatttatttacaaatttctgacactacgtgaaatatcacacacacacaacacaaataaactgaagtataagtagcaaaaatataaaaatagctataaaagtggtccattaacatatacgctataaactcataaacctgtaagcttttcaaaaacaccactgagtcatttctttatacaactctagttgtttattccaactgaccagttgatgtctatgatatgtagaataaattgtaatctgattgcaaatgcattaataaacaatttaagcccagttaatggctacacttttatgcatttatttttcatttgtaggcaaatatctaggcctctttggccataacaatgaataaaatacatgaggaccagttatttgccatggatagatatagagacaaaacatcagagttctacaaacctattttgaaaagtcagcatcctgactccagaggctaagtactgtatttcaattacaattatttttaaatgatgtgacattcatgtaataactctatagtaacagtctgtctgaaaaactcaagacatgtgtcacaatttatatgtttatccaactttagttatattcaaaggcttcatatatgtaaaagagctattctcataatactggaggaatattagtttccaatttcaactctcctatactacaacaaactttatgccttaaaacaacaaatatttattatcttgcagttgtggagttcagacgtctgagatgagttttatgtagctaaattcaagcattacacagagctgcattacttcccaaggctccaagagagaaatagtttccttgtgttttccagctttcagaagctgtctgtattccttgcatcatggtcccttcctccatcttcaatgtgcatcaccccaacctctgcttccataaggacatcttctttttctactatgctcctcttgcctcccttatataagaaccctcgtggttacattggacctggataatccaggataaccccacaaggtcaaaattcttaatttaatcacatcttcaaaatcttttttttagtatgtaaagcagcatattcacaggttctgaagactaaggtgtggctattttggagccattattcagtgcaccacacacccatataagagaacatggtgatatgcttcagaatttaatattcttatagaatggtttatgattaatgactgtcattagcagtctggattgtagttagtgaaaatggttaattcttctcatggtgttataaaccttattcaacctgactgtaatccatctgtgttgctaaaaaaatttcaactcagctaactcattttgaatgtaaaatattattatgattttgcacatcaatgtactcagcatttattcagttggatgactacattgtatgttaggcatttggtaaggaatgtagatacaacgatgaataaaaagtgatgtctgtcaaagatgaacaagaagaaactgtggggcagataatgtaaactgttacaatgtaaagaaaatcaaaatagtgtgaaggaacagaaaaagaaagcatcttgataagaaatactggtaaagacttcacagataaattagcaattcatttttattttttttaaatggtaaggattttcaccagtggtgatacagaggggagagataaaaggcattctaagaaattagaacaatttgtgaaaagatgtagggcagaaaacatgtggttgaaacaatatttgcaggtagacgaaagtaaagcctggatgatgtaaatgaccagaccttatggcttaaaaaacaggttaggatctgattttgaaaaattttaatgccatgccaaagaattggagctcagctcaaccataaagtgaagccactaaagaattctaaaatgggatgtgggttcttagagatgtgatttgagtctactatactgcagacactgttctaggtgctgggatacagcatagagcctatactctaagggccagttagcagtccattcgtgtgttctagtcttttaacttgatcactacttggttttgatcacttaatactcccaatataaaatattacatatatagtgaatatatatgggtctatgtgtacacacatacatatttataatactgaataagatgagggcgcttttcattcttatgtgtatctgaagtggaggaatgtaaatttctcagtggaatttaccttttcctttatccagaagggggcagcacatcccttgtgtaagaagataacgctagctttctccagaatgtctgcataagccagttttttaaaaatgagaacctgaattttaccgtgtttcttgtcagcttagaaaaaaattcttagtaaaagttgcccacttagaagtacatgaattccttcagatcagggaccgtctaatcttacagtaattcacgttcatttccctctctgggtgcctgatggaaaattaaattcccctccattccagactccatgacaactttcttgtggctcaatcctccacatggacttcctgagacacttcgcatattgatatatattttttcttttttgctccaattcaccttcacttatattaaaccagcatacaaagccatttggatataaacgaatcataagactcagaaggcttttctcctatcttgccttgattgatacaaaatcatggaccaaggcatgactttttctatcagttctcatcatgctctcattcttcacgaacttataaaataaaattgaagagattctagatggcagtactaaatgtctacatttgccttcatgtaaatcaacaactaaaccacttataaacatatgtgtctttaagctttgctttcagaattcctcctggcttccctttgcacactgtacgtcagttattcaggccattcaaactcctgtccaatgtgtccttgaaatgttgtgtgactgataacatgcctctaccttttcctgtctcacatggagctcattagtagtagtccccagtgtctattgttgacatcttcatgtccacgagtaccgttcatttaactcccacttataagtgagaacatgcgggatttggtcttctgttcttgtgttaattcacttagaataatggcctccagctgcatccatgtttctgcaaaggacatgatttcattttttatggctgcatagtattccatgttgtataggacatgatatcattcttttttatggctgcatagaattccatgatgtatatgaaccacacttcctttatccaatccactgttgatgggcacctaggctgattctgtctttgctattgtgaatagtgctgcaacgaatatgtaagtgcatgtatctttttggtagaacaatttattttcttttggatgtatatccagtaatgggattgctgggtcaagtgatatttctaagttctttgagaaatctccaaactgctttccacagtggccgaactaatttacactcctatcaacagtgtataagcattccccttttgccacagactcaccagcctctgttgcttttagattttttaataattggcattctgactcatgtgaaatgatatctcactggaattttgatttcatttctctgatgattagtgatatggagcatttttttctatggctgcttctctgtcttcttttgagaagtgttagttcatgtcttttgcccatttttcaatggggctatttgttttttgcttgttcaattatttaagtttcttatatggaaactttcatgttttaatgtctttgttgctcacattttgtttcctcttatagctatatttctctaaaggaagtttatcacacaaggaaaaattactaaatatcttagaaatattttgaagtgcttattaattaatgataaggataatttagaataattacatttacaaataatgtttataatactgattaatatcctaaatgtaaaaaaatccacatttctacatacaattatatatctaacatacacgtatggaatgtgctttctatttagagttgggaagatattttgctaggattcactagaccatgttaaagtcagccaaaacattattatagttgtcaatgtaagcatttcttgtgaaatgcagaatagattttaatatttattcattaattagctaaaactattgatctattttgttattatgcaaatgtattccaggtaaaaatctaccataattctgcagacaagtgtatctaaattatgcataatactctaattcttccatacaatgtacaagcggtggattaagaaaaaggacaaaataagctttttaatatgttttctgctgtgctcagtgagtacattaaaattatgtcccctttttcccacacttgcttgagctgttaacaaaagcataaagattacgattgccaaatctgtccagtctataaatcaaattaattattttctcaatcatttcagatctttgtttcaattttaataagttagaatagtttatctggccaaggaacttccaacaaagtttgctttattttgttaataggacagattatgttgatgaatttttgaatggtaaaatcagccttgcattcctagaattaatcttactcaatcatgctatatttatactggatttgaattgcagtattttgtttaggatttttattttatttatattttcaagagaaatcctgggctcttttttattttactttcttctgtgtgtgtgtgtgtgtgtgtgtgtacacatgagcatgtgtctgtatgctgcctttggtgttggtattgggtaatgctagccttgtataataaattgggagttttgctaccttctctgttttttgaaaaagactgtgtaggccagctgcggtggctcacgcctataatcccagcactttgggacactgaggaaggcggatcacctgaggtcaggagttcgagaccagcctgaccaacatggagaaaccccgtctctattacaaatacaaaattagctgggcgtggtgtcacatacctgtaatcctagctactcgggaggctgaggcaggagaatctcttgaacccaggaggcagaggttgcggtgagccgagattgcacctgggcaacaagagtgaaactccgtaaaaagactgtataaaactgtggttaattctttaaatgttgggtagatttgtccagtgaaatcatctggacttgaaattttctctattggataaacttttcaattactatatcaataattttaatagttactaggctattctaactgtttcattttgagtgagttttgggagtctgcattttttgaggaattgattcacgtctcaagctgtcaaattcatttgtattcatagtaattcccttactatccttttaatatctatggggtctgtagtagtaatctctcttttcatctagatattggcaatgggtgtcattctcttacttctttgtctgtcttgctagaatgctattgttttcaaataaccagcattttatttcacttattttttctattgtttttctgttttcattgatttttgctgttattggtattacttattttcttctgctgctttggtttggtttcctttgatcttctttattttatttatttattttttttttggaagtcaaagcacaaaagctatgaaaccatattggaatctgagacaaaagaaaatcagtaatattgatcttgtctttaattaaaatgtagatgttgcttacatcatagagttcagagtttttctcagtcatttcagatctttgattgtttcaattttagtaagttagaatctggccaaagaatttccaatgaagttcactttattttgttaatatgacagattatgttgatgaatttttgaatggtaaaatcagccttgcattcctagaattaatcttaatcatgctatatttataattaattttgatttttaaatgttacattaaagtattattcatgttaattattcagtttttagtgacctttaatctttgtcctgagttatgtgcttcactaacatagtcgtggtactgttcctgcttatatctgaccccttttatcaagaaatatgtaggattctgtgtctgtaacacttttaaagcctccctaatgatggcaagttagggaactatgttgtaattattccatgagaccatggtcttaaactgagttcccctgtaagcagccactaaggagtggctttatggggaactgatttatttaaaaatttttcccataaagatatacaatatttgtttgtcaataaataaatacatagtttaaaaatttattcccaagggcttttggtaaaagcgggtaggaagaggaagggggagaagaagaaaccaagaaagacttcaatttcagataaaatttcagggagggtggctccaatctgatctgattctgcaggggagtttaggagtgtaaattagttctcagacttacccttatttgaaggaagaagctgactttccaagttggatgaggtggattgaacataaaactcccagccacagccactctctcttccctttgagggcaaaacagctccagtagcttgtggctagtcttcagaaaaaagaatcaagatgctgacatggccataggaggcaaaagggccacacagcagcagaagtggcataaagaagtggtaaaaatcaacagatttgacagtgttggctacacctattatgtaaatacatcaattacaagcacagaatgactttcctatatttagatacttactgaaatacagactaaaatgactatttgcatatttcttactggctctatttacacacacacactctttctctctctatgtagataggtagatacgtacacacatctatatatgcacattctctctctttattaccaaggattggcctttaggtgctaaaaatttgatacctttggggggactagataagctatagtagataatgtagatatagtagtaatgtagtaatgtagtactgcagataaaggagatactagaaaggtagctagataagatatcaggaagagtgtctgtatttgccttgacacatttttaaatgtataagtacaaattctctttgtattattcttgaactttttaactcttgtaacacttaaaataatttatttttaactcaaatacttgtaggaagatgtctatattttatcactacaaattttattttatttattttttattttttattttttatttttttgagatggagtcttgctctgtcacccaggctagagtgcagtggtgcaatctcagctccctgcatcactacaaattttaaataaatactttatagtatatttaagtgaatccaattattttatatatgtatacatatgcagtataataggaagttacatattagagtttacataaatatacattatataagatacttaaaatctatacccacaaagcataacttacatataaatttaatcattgttatagctatatatgtctacttataactgtgacttgacattcaccaacatctacataaaatatgtaaaaaaaaaagctcctcctgaataaacatgttactttgtttgcattcttctttgaaataatatttccatttttcatatcaatatagagttatactaatttatttttaaaattattcctgcagattattttttggaagaaacatagtatataaagcaattgactatcttcgaattgagtatcttaaaatgtattctctttaatttattcatgtccttttaccatcaggggtatgctcactagtttgaagatctaaggttataatattctttaaaatctaattccataattaaatttaaattcattatataaatgtatcagaaatatttataatgtatttgcattataaatataaatttattacaaggacttaaatatgaagcttatatattaaaattctcttggttacgttataaaatcatgtctaccttgtcgctttacattcttagaaaactctatcttcataattagctaaaatatttaactatttgactctgaatcctttatttaaaaataaaatattaaaaatatatgacaacataaaatacaacttactcataattaatgaatttaaacaagaaaataatgtgcatatctactcctccttttttgcaaatcaaccttccaccatcccagagatacagaatattatatcatttaaaagaaaaagcagagtaatggggatacctatataccttatacctataacacaggtgatactagtttactttttaaaacatcccctgctaaaatacattgttgttattttctctgtaaactggaagtcttcttaaaatgttgttggccgggcacggtggctgatgcctgtaatcccagcactttgggaggccgaggcgggtggatcacgaggtcaggagaccaagaccatcccggccaacgtggtgaaaccccatctctactaaaatacaaaaattagctgggtgtgatggcgtgtgcctgtagtctcagctacttgggaggctgaggcaggagaatcgcttgaacccgggaggcggagattacagtgagccaagatcgggccactgcattccagcctggcaacagagtgagactccatctcaaaaaacaacaacaacaacaaaaacaaacaaagttgtcttcgtctcttaagtcagttgagtaatttataattgttgcatgttctaacagttttcccccaaaatacaaatatttccaacaataactataattaagatttttagcatataaaacatcaaatttttcaaataatcatgttgattgtggtcctaaattaagtttatattgaagaatatgtgtaagactcaagtctgttaggaaaaatcctaaatacttctcaaatgcttaatattgcacttaacaaaataattaatatgctaagatatagggctctttctttaatagattggtgttttgttaattagatgcatgaataatttaacacatttaatctatgatatttattatttaaactaattagatgtatggggattatcccatttaatcaaaatataatttattttaattatttctaggcaagtagtatagtgtttaggattcacaaagtttaacaatcaaagcataatatgcttattttatcatttttttttacttctaaacatttcagaaacaaaacaaaaaagtttctcagatcaaatgagtcacattagcaaaatgtaacaaggagaagaatgcaatgaagtaaaataacacaaacaattaactttcaagtgttgaggcgttattagaatgctattaactttcctggatataatttaggtgtcaaagaaaaacatatcttaaactgatagacactaaaatagtttagttaattttgcctcaagagaaagcacaaatggcttttccactggaaaaacaaaacaaatgtcatcatatttgtttctttaagaaagtataaaattatacaaaatcaatttttaggattttatttagaaacaaataccttagtggtctaaataatgtaaaaagggggatactatttggaggtagcaaatttttgtttcattagagggtaactttataaaaaaagttactgccatacttctcttaatgagatgtttttatgtagattattaaatcagacagcctatgaactcttttctatgtgagatgctacaatcaattatgaggggaaataacagattttatgcagagtggatagcagagggaaaattcagaaaaaatattaagggagaaagatgctattgccatagtcattctgttggaatcaatagaattaaagggtatgtattgccaaaacaagtgaatggaattacggggagaaacaagaatattgcgttggcaatacttggtgaaattcagcatgtacctcttctatggaaaacttttcccagatacatactagggaaattcacccacagaaacttaaaataggtatatctataaggatattcatagtaacattattcatgtgaatgagaagttgagtataattggagattcatacatacaaggaaacaaagtaaaatattgtacaggtatatgtggcatgttatgcagcagttagaaactataaatttatgtagaagagaggcaatttaaaaaataacaatatatatgtacaacataagtgctttagcaacatatctattcaaattaaacacacatacacaccactattcccaccagcagcagcaaccacactgtgttttcacagattcatggctattcaaagacaacagatgcattacagtgcatgcacactggagaaggggaatgggagtgggttttatgatggcgtaaggaaaaaagctatgtatctataaacatactataaatatggataagtctgaggtaggaggcaggcaggccacaactctggaccagattgaagactggccaaagcctagaagaggcacaaaagacacttctccataaaacatgcccaacagcgccatgacagcttaccattgccttggcacaagcaagaagttaccaatccttgccaaggtaatacccagaagttactgcccattttctagctcattccaaataatctgccccttacttagcataccattaaaagcgggtataaatgtgactacagaactgctcctgagtcgctactctccacatactgcctatggggtagccctgcttcggaggagcagtcacagagctgcaggactgctgccgcctcaataaggctgttttcttccaccaccagctcgctcttgaattaatacctgggtgaagccaagaacctgccctgcatcaagtttatgtgtatataagtgtacatacatatatatacatatgtatatataagtggctcttctacctgaatctcacagaagagtggcttctgtgttgtgtatgtaccctggtattaaggtgactaagccacttctatcctttgtggactcccatatatattgcagaggattgcagaaccctgaccataaccccgaatcagactccataaacaatatttggtacttaagcaaccaaagtgataactactccattccttcatgagacactcatctttaatttttctcactgaattattcttagcacgctaaatcgaggttaatacaataatttaaccctgctcatggagagtgtaaatgcacaattactctgtgtgtaaacatctgcagtactgttttaatgtgctgacagtttctaatgaaggtagcatgtatctgttaaagttgtaaaaatcactctaaattggccaggcacagtggctcacgcctgtaatcccagcactttggaggccgaggcgggtggatcacgaggtcaggagatcgagactatcctggttaacacggtgaaaccctatctctactaaaaatgcaaaaaattagctgggcgtggaggtgggtgcctgtagtcccagctactcgggaggctgaggcaggagaatggcgtgaacccgggagatggagcttgcagtgagccgagatggcgccaccgcactccagcctgtgtgaccgagcgagactccgtctcaaaaaaaaaaaaaaacaaacaaacaaacaaaaaaaaacactctaaattgaggcttaatttattaatttttaaaaacatttattagaggcttaaggacttcttaaaaccgaaaagacacaaatactctcatttcacagaagaagcttctgaggtcagtgaaactgcaatgttttgacaattactagatagtaaattaggggcaatctgagattaaagccaaattattctattgcttccttcagggatatttctactatagtatgttttattttcagatgtatagcatatattttgcatgttgttattgttcaaattatctttataccagttgctacaattcagatctggagggacctgtaaggtcatgtaaatgaacagaagcaatgaaaacgcataggtgtgtattgtgtgaacagacgtgaaaactgtaaagcaatttctctgcctaaagagaaatcctctactcagctccagttggcttctgccattggtggtgtatgccaaacgtgaccagatgtgttgctgttgctgttattcgaatttgttttgttttgttttgttttgtttgagacagattctcgctgtgtcaccggtgctggagtgcagtggcgccatcttggcccactgcaacctccgcctcccgggttcaagtgattctcctgcctcagcctcccgggtagctgggactacaggcgcgtgccacacgcctggctaattttttgtatttttagtagagatggggtttcaccgtattagccaagatggtctctatctcctgacctcgtgatctgcccgcctcagcctcccaaagtcctgggattacaggcgtgagccatcgcgcctgtccttgaacgtgtattttttaaagttatctttgaaataacaattgagcaagataaaggccagacaaaacccatatgggagatggatttggtctgcaggctgctgatttttttttttaatatactttaagttctgggatacatatgcagaacgtgcaggtttgttacataggtatacaagtgccatggtggtttgctgcacccatcaacccgccatctgtattaggtttttctcctacaggctgccgatttttaattacaacttatgcagtctgttgtgcaatcatacggaataatatcaacatcaattattgaatttaacaacagcagtatacttaccatcacagtcttcagtgcaagaatctattgaaagaaaataaaatgcactaataaaagcttcaagataaatggatgattataaaaattgacttatcatcattaaagtacattcctttaaggtctccaaacactgctgtgtatgtgaaatgtttactttaatgcaaacaaaggtagagataattaatctcattacaaataatctgagaaaataaacttgaaacaggtgatcaatgcaactataattacctttgataatccatttattaatcatatatgtgaattgtagataaatttccttagctcttgatacaattaagtaccttgtcaatttcttcattaatagttcagtgttgattggtaatttctttcagaattagttattgattatcgtgatgcaatgatgccactgacaaataattattttttagatgtggttgccctatggtataaaagttaatattcagttgaaatggcaaaataaacataaagtcacttcttattccttatctagtcgattcatctgccaatgaaatttggttttcttgggcttttaattatacttagaaaatagttttagagttattatattagctttatatgtcaacataagttttgtactaaaacaatgtttttaaactaccccccccccccaaagaaaaccctaaatggtgatatgtattatataaaaatggaatctgtgtttaaataattttgggaatgttacattctagaggttcattttgcaaaactagcatgccaaagattctgaagttttctagcaatgaatctttatccttatcttatttaacaaactatttctccagtttatttaagcggatcatttttccccttgattttgaggaaaacaatttagagaatgctaactcagaaggaaaaaagttgcccaaagccatacaactcatttaaattaagttcaaaaatgcctggcagattttctgattcctacaatatggcggcagagacgttaggctaaattatgtcaatatttttcctcagatgaatattaaaatctttaaaaattattcaacttttattataggttaaagggcgcatgtgcaggtttgttgcatgagtgaattgcatgacactgaggcttggggtctcaatgatcccgtcacctaggctgtaagcatagcacccaacaggtggttcttcaacgcatacccctctcccttcctcttttgtttagaggtccccagtctctactgttcacatcttaatgttcatgtgtattcaatgtttagctcccatgtataagtgagaacatgtggtatttggttttctgttcttgcattaggttgcttagggtaatggtctccagctgcatccatgtttctgtgaaggacacaatttcatttatggccgccaaatattctaaggtgcatatgtaccacattttcttcatccaatctactgttgatgagcacgtaggttgattccatgtctttgccattgtgaatactatggcaatgagcatgcgggtgcatgtgtccttttaatcgagtgagttattttcctttgggtatattctcagtagtgggattgctgggttgaatggtagttctattttagttctttgagaaatctccaaactgccttccacagtggctgaagtagtttgcattcccaccaacaatgtataagtattcctttttctctgcagcctcaccagcatctgttatttgcctttttaataatcaacattctgacttttgtgagatggtatctcattgtggttttgatttgcattaaaagaaaatgtcttaatcatgctaaattttctttgttagaagcatgcaaatttgtaatattcaccaattcaccaattttaattcgtcaaaaatttcacaagtgctaaagacgaaatttttataaaattagcattatcaagggaaataaattgtgaatcagtgaaacatgaaagtttgcctgtaaattttcaagcataattagattggtttagtagtatagaaaatggtaaaattaaaaagtgaaagcatctgttcatgtcatcctccaccttctgaaggggattatgcaaattgcccaagaaagcacagatttaaatagacccccaaactctctacagatactgccttgtttgaggtcacaactgccttcctatatctaggcaggacatgagacagttgcaggacaccatttcttccagctgattatggctcttacccagaagtggggacatgagaacttttctggctatactccagtccatgttgccttgacttttacctcaattttgtgtgttgtttgattctacctgtctgtctagctctctatggctcagcaagagagatggtttttaacttgatgttagaagttacttgagtgtgtatgtggctatatataaataaaaattaaaattaaaaattaaaaaattaaaacaaggcaattcaaactgcatttattttttttcctcagacctaaagggcagtcaggtttctcatttctggaagactgcactgattatttcaaggctgtgagtcaaggctgagtgaggattgtcacacacatatctactaatttatatcttttttccatattgtttataaaactttgcgtagaagtatttatatagacatagatataaaagttgacaaattttaagtctgtaggcccatatattttcacaaaccaaacatcctcaggcaatgggcacacaatccgagactacaatcagcttcagaaagagctcccttggtctccattagaatcactgtctttgattgggctgctataaccaaatagcatatttcacacctcacccacctcctactgacccaccttttggtgtttccaatgtctattattccactctgtaagtatgtatgtacccattgtttagctccaatttttaagtgagaatatgagatttttactttctctttctgagtcatttcactaaggatgatggcctcccattccaaccatgctgctgcaaaagacacatgatttttttctttttttatgattaggtacactaaaagcccagtacacaatgtatctatgcaacacaacttcacttgtaccctgaaatccataaaaataaaaaagatttaaaaaattatatatttgtttgcatggaagaccactgaaaatttaagaaacattaataccagatggctagcgagccatccaggcaggaaaaaaatctaataatcaagtcctatttcatatagatttaaaattttgcttgcactaagattaaaagtatttgcatatataatcaaaattattcatgatgtaatcatgtatgtatatgtacatgtgtaataggaatacttttggttttgttttttacaaatttatttagctatttttaaaatatcgaattcttttgaaaagtgtctgttcatgtcctttgcccaatttttatggggctgttagtttttttcttataaatttgtttaagttccttatagatgctgaatattagacctctgtcagatgcatagtttgtaaaaattttctcccattctgtaggttgtctgtttactctgctgacagtttcttttgctgtgcagaagcattttagtttaattaaattccacttgtccatttttgtttttattgcaaatgcttttggtgtctttgtcatgaaatttttgcccatgcctatgtcctgaatggtattgccttggttgtcttccagaatttttataattttgggttttatgtttaagtgtttgatccatgttgagttaatttttgtatatgttgtaaggaagggggtccattttcaatcttctgcatatggctagccagttctcccagtgccatttactgaatagagaatcctttccccattgcttgtttttgtcaggtttggtgaagatcagatagtagaaggtgtgaagccttatttctgggttctctattctgttccattggtctgttatgtaccagtaccattatgtgtctgttattgtaccagtaccatgctgttttgattactgtagccctgtagtatattttgaagtcagatagagcaatgcctccagctttgtcctttttgtaactgccttggctattcaggttctttttgcttctgtatgaattttaaaatagtttttttctagttctgtgaaaaatcccaatggtagttcaatgggaatagcattgaatctataaattgctttggtcagtatgcctattttaactgtgttgattcttgtctatgagcatggaatgtttttccatttgtgtcatctctgatttctttgagcaattttttcattgcagttcatgaaagagatctttcacctgcctggttaactatatccctacgtattttattctttttgtggcgattgtaaatgggagttcgttcatgatttggcactcagcttgactattgttggtatataggaatgctagtgatttttgcaaattaattttgtaacttgagactttgctgaaattgtttataagcttaagaagcttttcggctggccaggcacagtggctcacacttgtaatcccagcactttgggaggccgaggggggcagatcatttgaggtcaggagtttgaaaccaccctgaccaacatgatgaaaccccatctctactaaaaatacaaaaattagccaggcatgatggtgggcaactgtaatcccacctactcaggaggctgaggccagagaattgcttgagcccggcaggtggaggttgcagtgagcacagattgtgtcattgcactccagcctgggcgacagagcgagactctgtcccacaaaacaaaacaaaaaaaccaaaccaaaacaataataaaacaaacaaacaaaaagtttttgggctgagttaatggggttttctagatatagaatcatgttatctgcaaacagggatagtttgacctcctctcttgctatttgaatgccctttatttctttcacttgcctgattgctctgtccagaactccaatactatgttgaataggagtggcgagaggggcatccttgtcttgtgcaagtattaaggggaatgcttccagcttttgcccattcagtatgatgttcgctgagggtttgtcatagatggctctttttttaaatttatcattttctttatcattggagggaaagaaagcaagcagaggtgggggtatggttactctatttaaggaagagccgaatacaaagacaatgagcctttcatagtctcaagaattccacaatgaataactgaattatctcatttataattcacactggatcaaaaaaattggttcccctctgtgtagatcaatttaattcaaaccttattatcttcagaatacagagaggaatactacaagataaactctaactgcactaggtgttttctaagtagaagaccaaacaccaaagggaatccctctttccgacgtcttttgatatgacaagattttgccagagtggaagtctaacacttaaaaaagcattctcatggccaagtaagaaactacagttgttgtgggtattacaatacaattaccatatgtactacatattaaattaaactcagcattaaatatgcttctaaaattatgctgttaatgatgataacagtgatgatgctggtggaaaaagcctgtctttagcccaagaaaagtaagggagaaaaatttaacaagcagaaagcagacacagagttgggcatttttttgactaggaaagataattttaaacaaagacatataaaaagaaaagtaatcccttatttcccctatgtggaaataatatgaaatatttattagatatattggacaagagcagaactaagtactccaactgtactgcaggattacaaaaaaatcatcccttcaccacagtgtaaggtttaagggcaatctgcaaaagtatgcatgttatataaaggacagcaagattgctgctgccctgccaagtacttccagtccctacccaggtcctactgaaatagtggtggtcccaattagttttattgatataaatctttaaagaaaaagataaagcatttaaaaagacaagtcaaaatgcttcaggaaccatatatccaacacaaactttatcctcaaatgagttatgtttccctcacactaatatacttttatttcactcaaactagagcaataatcttccatacatatgtatattccctgcccaataattcaaagaaaaaaatccaaaatggttagcaaataaaaatatgataattaacagatgctttaaatttgttttaaatatttttaaggtttaaaaggtgtttgaagtttgtaattcctagtaggaaaacattatctgaatgaataccctaatggcaaaccactgtaaaatgtttcagctgcatttgagggagaggggtaggaattatcttcaaagcaccccagatcttttgatgagaaggtcagaggtacactggtttgtattattgtgacatctgtaaggtgatcttggttgcttttccttcagcaagggctttatttatcagaagggcattatgcttgacctccaaatttggctcacaatttactgataagattcataacctttgggttgctctggtattttgatatatttgctgggttctgagccacatcctggaaggccaccataacttctggatcctgcatggctgtaagaacctctggatcactaagaatttcattaagcccaggcattctggccactcctggtatgccccctccgattccaggcattcttccaagaaaattaccaggcattaccccaggaaagccacctggaaaagagccatactgagctcctgactgttgtctggctgcttcctccctctgggctctctcatgctcttctcatgccttcttaactctttctactctttctttgatctctcacccttcacatttttgctcatactttctccgatgttctgcaattttctgagccctaaattggacttctttcagcgttgcactagcatctttatcatactccaatttacagacaagggcaagatcatgggctgctcctttccagtggcctggaagcctgtgtgctttccctcgccacttgtaaggctgagctaaatcaggatttatttcaatggctctgtcacagtgttggatggcagcatttggcttctgtaatttgacaaagacactggccctcttggcatacaaaatggccaagtgaggattcagcttaatggcatctgtgaaaacgtcaatggctttctgcagttcaccatcatttagggcttcaatagcagctactttcttatcatttgcctgatccatcatctcctctgttatctctgcattttcatctctcatttcttgaggggcatcagtgtctggttcaatcacaccttcattatcaatttctagatcactttcctcacttgatggtttgtctgcctttaagtcttcctccactttcttactaccaggtttttcttccttggtattttcgtctgatttagctttctgagtagcaggtggtatttaccccccatactctccacccacaccctcaggaagcacatttcctcggtgtgcagaacgctcggatcctgcttacacattttcacaaaggcccgaagctcgttcactttgtggggttccatggtcaggaggcggtgggcgaagctgaggggctgtggccgggttccaggcccaggcgctgacttggcatgactgtgcagaagggggcggctgccgcaagtcagagcagactcagatggatcttactattttgaggtatgttctttcaatacccagtttattaaaggattttagcaaggattttgaattttatcaaaagctttctctgcatctattgagataatcatgttttttgtcttcagttctgtttatgtgatgaatcacatttattgattgtgataccaaccttgttgaaccaaccttgcatcctggggatgatgcctacttgatcatgatggataagctttttcttgggctgctggattcaatttgccagtattttgctgagaacttttgcattgatgttcattacattaaggatattggcctgaattatctttttttgttatataactgccaggttttgcttataaggataatgctggccttatagaataagttagggagaagtctctctttttcaatgttttggaatagtttcagtaggagtggtatcagctcttctttgtacatctggtagaattcagctgcaaattcatctggccctggacttgttttggttggtgggctatttattacagcctcaatttcagaactcattattggtctgttcagggattcagtttatttctggttcagtcttggaagggtgtatgggagtgtaaattagttcagccattgtggaagacagtgtggtgattccccaaagacctaaagacagaaacaccattcaaccccacaatcttattactgagtatatacccaaagaaatataaatcattctattgtaaagacacatgcacacgtatgttcattgtagcactatccacaatagcaaagacatggaatcaaccaaatgcccatcagagatagactggataaagaaaatgtggtacatagacaccacagaatactatgcacccatgaaaaagaatgacatcaagtcctttgcagggacatgtatggagttggaggccattatccttagcaaactaacacagaaacagaaaaccagaaatggcatgttctcacttataagtggaaggtaatgatgagaacacatgaacacatagatgggaacaatatacactggggcctttcagaaggcagagggtgggaggagggagaggatcaggaaaaacaactaatgggtagtagaatacctaggtgatgaaataatctgtacaacaaacccccacgacaaaagcttacctatgtaacaaacctgcacttgtacccttgaacttaaaataaaagttaaaaaaattccaaatgtaaaaatatatatataatataaaactcacccattttgtgcatacaattaaattatttcagtaactttactgagtgcgacaaccatcaccataagtcagctttggaagattttcatcaccctaataacagccatcatgcccatttagttaagtctcttttccacagtggctacatggtgttctgcaaaatgaatataccataattttatttagtattaagtctaaaacatctagaatgtttccttcttttcccaattcaaaataaactttaataaatatctttgtggtcaaacaacaacaacaaaataccataatctgggtggcttaaaaacaacagaaatttatttctcatatctctggaggctgggaagtcttagaacaaggtgccaacagattcagtgactggtgaagactctcttcctggttcacagatggcaccctctcactgtgttctcacatgttggaaggagcgagaaagctctctggggccttttataaagggcactaatctgattgatgagggctttgcccctatgttctaatcacctcccaaaagttctgccttcaaatattatcgtactggggattaggtttcaacatgtgaattttggggggaatacgaacatccagaccatagcaggcacattatcaagtaattactgtttcttccatccagttgagaaattctgggagagatagagtagaatatctcagacttatcccaactgagggaagaggtgactggtattgtcattggtttatatttatttcagccattctgatgggtgtatatttgtattacattgtcctttccctattctctatattttttgtccttctcattttgatgttttttatatatttggagttctgtatatatttggatctctctcttctttttaagctatatgtgtagccaatatctctcccattgtatgtattgacttctcacacttttaatgtcatttgattaatagaagttttacatttttaatagagttcaatttatcaatattttcttttatgtttagcacttttttggtcttgtttacaaactctttgcctactcaacaccatttgttaaaaagacaattttttccatttagtttctttcacttaataatatgcatttacgatttctccatatcttttcaggacatgatagctcaccttctattagtgctgaataatatttcattgtctagttgtactacagtttatttgttcattcacctactggaggacatcttggttgctgccaagttttggcaattatgaatgaagctgctataaacattcacgtgcaaggttttgtgtggaaataagatttcaaatattttccataaataccaaggagcacaactgatggatcatacagtaagaataagtttagttctgtaagaactgccaaactgtcttccaaagttgctgcagcattttttatttttagcagcaaagttgctgctgtttcacatcttcctcaggatatataatgcatgactccaactatatgacattcaggtaaaggcaaaactttgaagagtaaaaagatcagtggttgcaaggggttggggagagcgaggatgaataggtgaagcacagaggattttagggtggtgaaattaccccgtgggatgctgtaatggtacataaatatcattatgaatttgtctaaacacatagaatgtacaacaccaagtgtgaactttaacaatgtgccaatgaaggttcaccagttgtaacaagtgtccactgtgacatgggatgttgacagtaagagagggtgtgtatgtgtaaggggcaggaagtatatgggaactctctgtactttccactcaattttgtgatgaacgtataactgttctaaaacatattaatacatacatatgtatattttataaataaatatgtatacaaatataaatagtgggttataattacatatatatatatcctattatttgctcactgaattgtagcaatttgtcacaaattatgtgactatattgtgggggtgagcttctagactctcaagtctcttattttgtatcgttgaatcaatagcacactgttttaattactatagaattataataggtctcaataactagtgatgtatttttcttctattacacatgattgctggaggtaatttggagacactgttggtcagattattgttcagattcatctcattttctgagagatttttgtttagtttcgttttcattcttttttttccctttagtaaatatttgttgaattttgccagatactttttattacatatattgggacatttgaataatttttgtttttttttctgttaatgttgtgaataatgttgactgattttagaaattaaatccttccctgcattgctgaattaaaattacacttgaatggtatttctattcttctacaactcttttaaattttattttctgttatttctctagctccttgaggttagtgcttaaataattgtgttttcatatatcactggattcaattttctactcttttgcttagggtttttgtgtctatattcatgaggattactctaatttaatctttcttgttacatccttgtcagattttggcatcagtttatatcttgattagcagttctagaaatttaatctgttttattattcttttaaagagccaaagcctgacttttacatttctttcattgtgcatttttaaaataatttatattcttagcttttttcctttgcatcctataaattttaatttgctattctttctctagcttcttgagttagaaaattatatatttttttctaatttatacatttaaagctacaaattgttctgaaccatatgttagctgcattacacaagtttgatatatcttgtcttcattaaaatgaaagtgattttttaattgatacataagagttgtatatatttatggggtacatgttatattttgatacatgcatacaatgtgtaaaaatcacattagggtaattgggttatatatcatctcaaacatttataatttctttgtgttgggaacattccaaacctttcctcataggtatttgaaaatgtactataaattcttgttaactgtagttgccctactgggctactcaacattaaaacttatttcctctatctaagtatatttttaaccaactttctttttgaatttttattgtgatattttcttttgcctatgaataagcatgttgcataactttctggtagataggatatatttttgttattttgttattgacttttaattccactctggtaagagaacataatctacataacttcaatgttttaaagttttttggggtttctgcatgtctcaacatctggccacttttggtaaattatccattagcatttgaaaataaggtaagttctgaggttgttggggacagcattttacatagggaatttgttaattatgtttgttagatcttctaatctatagaagattatttagttcttgtctactaattgtaacaggtatttagagaggtttgttaatgtcttctacttttattaattgcctatcccttctaattctgatgatttttgttttaagtattttgaagtttctttatttaatgcaagcagatttagattggcatattgtctttttctattaactcctttatcatgatataaaattctttcgccgggcgtggtggctcatgcctgtaatcctagcactttgggaggccaaggcgggcagatcacttgaggtcaggagttagagaccagcctgaccaacatggcaaaaccccgtctctactaaaaatacaaaaattagcctgctgcaatggcatgcgcctgtaatcctagctactccagaagctgagatgggagaatggcttgaacccaggaggcagaggttgcagtgagccgagatcgtgtcactggactccagcctaggtgacagagtgagactctgtcttaaaaaaaaaaaaaaaaaaattcatttacagcaactcttctttacatgaagcacactttttttcaatattagtaaagctacatacacatgtattgccttagcctcaattttaccagtatatcttgcagtccctcattttcaacatttttgtgacctcatctttaacatatgtctcttctaggcagtagtaggtagcacagaaggttttatttgttcacttgtttgttttccccatccagccccctgtaactatgtaaagctccattgagtcatctcggtccctctgtagcactcttcttcctaggtcaatcccagaattcaagcctctagacaaggtacaggagtttaaccagaaacagcagaagagattcagatagactctgacatactctaaaattttacttcttgtagtgacttctgtgaatctctgtctgtatatgtagtaaataatttgacttttcaggtggttctcagcagaattgttatcctgtgaagtactccatctatctaaaagcagaagtcaggatgatttttaaaaaatatttctaaatattgtacaaaatgatatcagtaaggcattttaaacttgggactcttacattaggctagcagaagaatttttttatggaaaagacatatgcaatggtaagttaatgattaccagtcaggatttcagagaaaacaagaaataattaaatcataagtggtctatgtttccgtagtcacatcatatctgttaccatttttatgaaaatattatgattgttattgacataattcctaaaatacttttacatgtttctttcagttgttaatacaatattttgtttccgaaaaaatccttgaaaaagccaagcggaaattatgtgacatgtttctttatattacgtgaaatttaaggtctaaaatgaacaaaatctatttgatctttttcagtagcatgaaccagaaagcctaatcttcattattggcaaatgcttctcatactcttctgtttccataggtgaagtattgctacatcagtagtttcaaaggaacagctgtcagatatcactaaagcaaaatgcaaaccatcagttccacagttatcaatagctaatatggacaagttgaaacatcttcacatccttatgagactaaaaagttgttttgtatagtctaagtttattcatttttagttaaattttagttaaatttagatttttcttttgtggagcttatggtctttaagaaccagtgattttctcgattttctctgtgtctaggcaaaatgccttcagttgacccaagccctgtcatcactccaggcaaaactgtgtattctgctttcattttcttttatttatttttcaaattgacataaaaaattatatgtcttcaccatgtacgacatgatgttttgaagcatatataaatcgtggaatgattaaatttagataattaacatatacattacctcacaggagtatttttatggtgagaacactttatgtccactctcttagcatgtttcaagaatacaatacattgttatccatagtcaccatgtcgtataatagatctcttagaaattattcctcacagctaactgaaattattcctcacagctaactgaaattttgtatcctttgaccaaaatctctagtaaacttaggagagtttgatttatttgaaaatttgtgattactcatcttaaacttgtttgttctttgggtattttttttttttttttttgagacagagtctggctctgttgcccaggctggagtgcagtggtgcaatcttggctcatggcaacctctgcctcctgggttcaaacaattctccctgcctcagcctcctgagtagctgggattacaggcacatgctactacgcccggtcaagttttgtatttttagtagagagaaggtttcaccatgttggtcaggctggtctcaaactcctggcctcaagtgatccacccaccttggcctcccaaagtgctgggattacagctgtgagccaatgcacccagccttctttggatattttttttcagatgtttactctcatattttattttggaaacaaaactggtaaaatgtataattctgttttaaatgtgttattatcattagtaagaatatacaatcattattgattttttaaaaagagcgtcaatcaaagtgaataaacctttcatgtaatgagttgaattcacagctgtatttgcttgagaggtaaaaaaagacaaaactaatgggtgtgaaaataaaggatctagcttaaatatagtttgttaagcctgggttgtaaacatggaacataacaaacatattctaaaaattgtggttatttgacagcggcaggagacagacaaattcctaggcagacaggggcgggtccccggtgaaacctgaccttaaaaccaaagacaatttaaagcctgaaaacctagctgccagttctgggtaaagtccacaattggagtgagaacttcctcagtgccttttagccagtcaaatggtgctttatccaggcctgcccacggaccaatcaacacaaactcccccattctgagtccataaaagccctggactcagacacactttaggttacccacttttcggccccctctcacacagtggcttgcccacattgggtcccctctcattgtcaaaagcttttctatcactctataaaattcttcttcaccttgttcactcaccagtgtctacataacctaattcttcttgactgtgggacaaaaacccagagcccaccaaatgacaagtgtgaaaggggctgtaacactgtaaccctccctcccactcaccaagcaatggggagaaagagctgctgggtgtcacatgccaccccttcatttgtcacactgtgggcagcaagattgaatgtaagctgtaacacgcacccccatgtgccacactgtgggtggtgggaaaaaacaagaactgtaacagtccttcgggggtcagacctcaggactcactgggtgagagccatagcaccccttgggtctctgcaattgctggcatctctgagtttttgggcaccaccatgttcccttcatccagacacctgcacccgaggctgaagcaggtcacagcatgcctggcccagctgcagactaaacacagagccatagtgggtgtcaaatccaggctggtagcacaagctgagtgcagctgccaggccaagcgaatggagtgagcccagtggcaagcccagagctgagcaaagcccaggcagaggtgctactggctgcagagatttctggctggcaaagtagcactgaaagaatcctgtaacattttgacatagaccaatagaactaatagaaccaggaaggaagagtatttctttccattcacacaaaaatgtatttttctttttcttcttgttgcgttcaacatctaatggttctcaaatatatttcatttataatagagttctcataacatttatttattatgtattctgataaataatctggccaaaatggcattaaacaatgatcacacttcctgtttaattcaaattattaaaaaaaattagactaaacttgaaccctttttttttttttttttttttatgagagactaggtcttaccatgttgcctgggctggtcacaaactcctgagctcaagcaattcacctgcctcagcctcccaaagtgctggaattacaggcatgagccaccatgtctggccaaaaacttttaaaaataattaaaaatatacatgtagcaaaataatgcatgcaattgtttatcaaatctcttaagtaattactgtcatagtttatttctaataggagacaaagtcatttgcaaaataatatttaaagagtttttaatagaaaatgctgtctctatatatatcatgtaatcagtagatatttatgagaggcatatttatcagactggatttttttaaaaactggaataaaaaatccagtttggccagtggaaatacaagaccattcattgcactaataataataataagccaaaagaagatagtaataataataaaccaaaagaaaagccaccaaatatctgccaatagcagaatgatcaaataataccgtatgccttaccctataactataaaaagaaaaaatgtacatatatatatacatgtatgtgtatgcatatacatatatacatgtatgtgtatgcatatgcatatatacatgtgtgtatgcgtatgcatatatacatgtgtgtgtatgcatatgcatatatacatgtgtgtgtatgcatatacatgtatgcatatatatacacacacatcaggatatatctatatctgacatggagtgagcgaaaatccaaatttttaagacagataggtagttacataaagtctggaagatatgcatcactttttttaagccagtgattactgactggaacagtaggataggagacaggcttaggataattttgttttaactttctacatacctgtattgtttaaatcactttttgtcttattgttagcaaataacaacatattaactgcatataaaaaccattaaaaagttaagaatagcacatcaggcatagacagcaataaacaacacactcattgatgttcaaaacttaaatttctgtgccaggaaatacaaaaggcttgctatcatttaaagtatacatttcaaaatgaagccctgataggagaaggtcactaaatgggacctagacttacagattcttgctgagtcacttagactttatttgtaggtgaaaaagatcgattttttttatcttaagcaaaggagcagaaagtgacacaaacaagtttactctttcaaattaagcaaaccagatcattactcgaaggtgttagaggacgtaatgaacttggaggtggtggaggataggagattaagaagagacacaagaagtttactgaaatagtgcaggtgagaaataattaggacctgaaaaatgagaataggtacagatgataagtacagtgtttgaatgtttttttgttgttgttgttttgttttgtttttgatgactgtggatcaccaatgttgatatattgagcagatttttagatatatgtatgaattgcaaggtgaagttcaagactgaaaaaggaagatttaagtactttccaggccatacatagaaattaaagccatttatatagtgagtgaagtccacctgggagagcattaatgagagaagaaaagtgaaaccagagaagaacgttcagaaatacaaattaattttgttaggctgaggcaatgacgctccatgaaatggaacagtgagagtaaaaagaggaaaggtattagggaatggaagtagcacaagagctaagaatgagtcaatagtacacaaaacaacattccagaaataattaaaaattaataaggatataaaacagtttattagagtattagtcacatagaatatcatgattttatatttttgtgacttgatttaaatggaagagtataattactaattaaaaccttgacatttacctcagtaaattgccaccagaaatctacgttttaacaaaatcaatggctagaggtatcatctatttctagatgactatacacacaacattggaacacctacatgtgctatgctttctaagtatgttagggtgagtgggtacttaaattttctacaactttaacccaaaaggcaaaatttcccagaggataatgtttagaattaacaagaccaactaattaaatttaatcaggtcaacccaaatgagataattagcataattaattttgattttaaactgtcccaaggggatgcagtatttgcatatttgagagaagaacttcaatgagggaaagatagaaggaaacggggaaatcaatttaaaatgtagaaaagtgacacgaagtaatttgacattttatatataaattaatatatataattatatacattatatgttaataatatataagtataataatatattattgccatatatactatatattttatatacataattatatataaattgtttatttatatatactttgacattttatatataagaaggactcgttttattagaatgtgtaactatctaagtgtaatcagaaagacttttcctcaagttctgtcttaggaggagtgttgtatttactttctattttaaaatgatctgagcattttactttgttaaatgaattgggatggcaaataaaaatgtaaattggaatatatttgttggagtaaggatctttagttcacagtatttgagttaattttgccaaagcattcaactcattttgaataagaagctgagataaaacaactacactctattgagacagtattatatagctgtgattaagagaaagacctacatttttccacaagttagtatccttgatgttaggatgtgtcttataactggtagatattttttcttttcttctggtataaaatactggtgataccgaaaaatgatagcgtcatagattagataaaatatggtagtgagtaaggcatttcccactctgagattatacttcaagagtataaactaattgtatcatgatttcttataatatttttcatttaaaatatacataaatataataagtacaaatcactatataacttaaagtatacatccaggtaacaatgatccaagtcaaaaaactttttgtgatcccttccatttcttctaagtgtaacacttattttgacttctatggcaccctctttgtttcttttaaattttttcatcatgtatgttttctagaaaatgtagcttgattttacctgtttttaaagtttagaaaatgaaattctactaaatgtattgtttttatttgcttcttattcatattcttgctgcttcttatttattgtgtattcattaaaaaatttatttccataattcctcccatatccttactggggaacaggtggtgtttgactacatgagtaagttctttagtggtgatctgtgagattttggtgcacccgtcacccgagcagtatacactgcacacaatttgtagtcttttatccctcatccctttcccaccctttccctctaggtccccaaagtcaattgtgtcattcttatgcctttgcatcctcatagcttagctcccacttataagtgaattcatacaatgtttggttttccattctctagttacttcatttagaataatagtctgcagcctcatgcaggttgctgcaaatgtcattaaatcattcctttttatggctgagtagtattctgtcacacatacataaaccatagtttctttatccactcgttgattgatggacatttgggttagttccacatttttgcaattgaaaattgtgcttctctaaacatgcatgtgcaagattcttttttgtctaaggacttcttttcctttgggtaaatacccagtagtggggttgctggatcaaatgggagttctacttttagttatttaaggaatctccacaccgttttccatagtggttgtattagtttacatttccaccagcagtgtggaagtgttccctgttctctgcatacatgccaacatctgttttttttttttttttttttgactttttgatgatggccatccttacaggagtaagatggtatcacattgtggttttgatttgcatttccctagtaattagtgatgttgaacatttcttcatatgtttgttggtcatttgtatatcttctttcgagaattgtctattcatgtccttagcccacttttggatgggattgttggtttttttcttgctaatttgtttgagttcattgtatattctggatattagtcctttgtcagatgtatagattgtgaagattttctctcattctgtgggttgtctgtttactctgctgattgctccttttgccatgcaaaagctcttcagtttaattaagtcccaactatttatctttgtttttattgcatttgcttttgggttcttggtcatgaaatccttacctaaaggaatgtctagaaggcttttcccgatgttatcgtctagaatttttatagtttcaggtcttagatttaagcccttgatccatcttgagttgatttttgtgtaaggtgagagatgaggatccagtttcattctcttacatgtggcttgccaattatccagcaccatttgtcgaatagagtggcctttccccaacttatgtttttgtttgttttgtcgatgatcagtttgctataagtatttgggtttatttctgagttctctattctgttctgtgcctatttttatcccagtgccatgctgttttggtgactatggacttatagtatagtttgaaatcaggtaatatgatgcctccagatttgttccgtttgctcagtcttgctttggctttgtgggctcttttttgcttcttaatacaatgtcgtgtttgtgagattgaaccatgtctttgagtgtacagtacaaataatttttttgagaataagtggtcactctgatggatcatcactcccaaattctctactgtgtgtttctataagaaggacatctttcaatgtgaccataaaacacccatcccaatcagaaatatagcatttatcaattactgacttctaatcctcagagcctattaaatttttgccaattgtttgcaaatgtcttttatagcaaaataatccagttaagacttacatattagcgttcaggttgctttagttgtcaggtattcagccttctttagtttggaaggcttacctgatgtttccttatgattagattcaggttatataccttagcagaaataacacagaagagacgttatgttctcattgcatctatcagataaagaacaatttttatttgtttcattagtttttttaaaagtgaaagcaattttattatgaaagtaaaggaataaagaatggctacttcataggcagagcagccaatttatttcatttctgattatatttaatttgatcatttgaacaagttggtgtctaacagttttctctttttttccttttaaattaataaatattttgtggataggtactttcaaactatgtacttatgcacttttgcaacttttgtttcttatgcaacttttgatatgttcatgaaaatgtttatattagtatggtctcgtggattcctattttatccaatcggttataattcattactattattacatattttgatgctcaaattgtcctaatttcctagtgggaccctgttcaagctgacttctgtgtctttttctcatgtttccaactttctttgagagcctcctttatttctgacacaacggtgcattctagccttttcttgtaatctccctgccccagacctagaatcaaccactttcccaaggatccaatatctaggtgccaggtgtgtgcactgtagacaggtcctcactgtagacagagctagggaatacatgtacgtttacacatgcaggcacatatacagagagctgcatagatagattgaaggacagggaagctcttcaaggttcatttgagttttattcctttccatatgtgtaacttcctttttgacagggagaaactacctcccataaccttaattatttactttttaaaaataatcatccctcccttttctatcaccttactgtgtgtagcacccaacaccaggccacgccacaccaatagagaagccttcctgacccaactcaggctcttattcccaacaccagctgtcccttcttgccaaggtagtacagagatttctcacttaccccacacagttttctttattattaatgtctaatgttagcaaggtatgtttgttacaatgaatgcaccaatttcaatacattgttagctaatgaattccatatttcattcagactttcttagtttttgcctaatgtccctttatttacctaatgttccaggatccaatccagaacatgatattacatttagtgtccatgcctccttaggctcctcttggctgtgagaggttttttagaatttccttacttttgatgtcttacatggttttgaggtgtactggtcagatattttgtaaattgtccccaaaatatgattttaatgatggtttttttcataattagactgaggttgtgcattgtgagttgaaagaccacagagcaaaagtgctattttcatcttatcatatcaaaggcacatactaccaacctgacttaataatattgatattgaccttggtcacatgactaaggttgtggttgccagcttaatcttactgtaaagttactcttttctccctttccacactgtactctttggaaagaattcataatcagctgccaaaattaaagagtggggagttatgttccatgtcattgagaaataagaatttatatacattatttggatttcttctgcacacagatttttgtattcttcccattttatttatttattcaatacttacttgatgctacagattgtaattcaggacttttttttttttttttttttttttttttttgagacggagtctcgccctgttgccaggctggagtgcatagtgcgatctctgctcactgcaacctctgcctcccaggttcaagtgattcccctgcttcagcctcccgagtggctgggactacaggcatgcaccactgcacccagccaatttttgtacttttagtagagacagggtttcaccatgttggccagcatggtctcaatctcttgacttcgtgatctgcctgccttggcctcccaaagtgctaggattacaggcatgagtctgcacctggcccaggactaacttttttataccctgctcaaattgtcttagccttccgtattgttgagagatctttctgttggatcctacatctctttgatattacctccaccattcgttgtgggttatttcttttctctccttgtttttaaacactattactatctggcaataaagatctttcaagattcacctatattcccttggtttctttgatcagaaaatagcattagaaaccatgatttgagtactaaatgtgctcatttctactgctgtgccatggcttctcggccctctcagttgacagatcaggagaatataggtgtgtgtgctaacgtgtgtccatacagatacctataaatatttttatgaaaccacctgtatctgtattaagataattgtgaattgatatggcatcttcaactataatctattaccacattgattattttagcctcctcccttgcttatctgtaacttcttccttcaatagagacttggctcatgccatcttttatccatttgcttaattgttcaatcccagtttacatgtagagcagtatcagagtccttagcccacagagtacagtagtttatgtactttcttttaactttagttttcctgcctacttaattcaaagtgacttagtcctgtgccttttcctcattcccttcagggaggtactttcataaatttcttacagagttaaattattttaccacattctgaattccatcctgggataccagacatatgaaataatttctttaaatttacatatattaaattaattcttcctgttgtatagttctatatgttttgacatatgcctagtgtcatgagtccaccattataatatcatacagaatatttcctctttcctaaacaatctcctgtacttcaatattcaatcctcttatagtcctctgatgccctgacaaccactcatctttttatcatctctctgattttgacaatctcattatgttatattattggaatcctgcagtatgtagcctgttcagaatggcttctttcacataacaatatgcatttagattatctccctgttttcttgtgccttcatagcttattttcattaataaataatatgccaatgttcggatgtaccaaagtttagcttttctttcattgaagaatatttggttgattccaaagttggtgatgatcaataaagctgttataattgttttcaggtgtcatatggacatacatttttaaatatattgggtaaatactaagtgagtgttaaattgcgtggtaaaactatgtttagctttgtaagaaaatgttaaactgacttaaagtagttgtacccatttctgtttgcacttgtagtgaaggagagctcctattgctttgcatcctcccagcaattggtattatcaggttttataaattcatcattctaatggtgtatagcagtatctccttgttttaatgtgcaattctttaatgttagtggtggtatcttttcatatacttatctgccattcgtagctcttgtttgctgaggtgtctgttcagatcatttgtgcatttgtgtctttttttcttattgttaattttaagagatttttatataatgggggtataagtccttgatgagatatgtgcttaaatatattttcttcaagtctatggcttgtctttttgttctctccacaatgtctttcagagaacagaagtttttaattttagtaaagtccaaattatcaatgtttttcttgcaaggatcatgacctggtgttctatctaaacactcattaccaaaataaaggtcacataggtcttcttctgtgttttcttgtagaagttttacagtatttcatttttatatttatatctattatccctttccagttgtaatagtaaggtctgagtctaggtgtatttttctgtagatggactggggtgctgacttccatggtccttacacattgaagctgatatgtaaaacgtgtcccaaaggacatctttaataaaaaaagtaaggtgtggaatcatgtgtatagtttgttactttatctataaaagaggttattttatcaaatataactctctctatatacatacatatatatgtatgtatcctctacatggtatcagtgtaaatcctattttatatatatatatatatatatagagagagagagagagagagagagatagcttttaatggcccttatttttcatgtcaaaaaacacaattagtttagtaccaacctaatttttgcaatctttctctctctggaggattatatttgtttctccctacctaatgaattaataaatacaaaacaaactgattaaatgttgaggagaggggacattgggctctgcatacataatagacaggggtagaggagatattttggctttgtgcatatatatatatacacacacacacatacacatacatacatatttaattgttagatttttagtactaacgtatttcttcctaaaaaaaaaaaaatagaaaattgggtaattttttaaatgttccaaatactgttttctttctgtgtgaatatttcccagtttatcttttctctttctttctgtcatcctttcccctagtaattaacaatttcactttaggatactggtatgaggttctctatacctgctaaggagttactgaagaagtctcctgtttgcgtctctccatttatattgtgtgtgtgatatcctggcagagaatcacagaaattgttgctcctgtgtatgattaccttgaactacggtgcaatgataaaatgtttgatagatggtcctaaattgattatacgctttctctgtaaatgaaataacagagaggaagcccaatttatacatacaggaaaatgatggaatgtgtctgtatatcttactaacttggaatttctagaacaagttggaatactattgacataattattttataaagatcaaatttggttaacttcgtattttatgtttaaaatagcaaaagaaacacagatgttttgcttataatatcaaaataaataatttctgtggaatctaaaattgactagtaaatctgaattttatgtttcattaaggctgaatatgtctctaatacttattatagataccaagacagattcattattatagactactttacaaactttactgctgaacctaatatcttagttattgcacacttttaatacagtatacaaaaatgaatgaagattatctatagtgcccatagatgagaattaacttatttttaaagaaaacgcctcaaaatatggctcaacagtctttttcaaagacacatcctcaatgtctgaagctattatttacagctaaaccctattgtgactcttataagcataaagaagtggtatgcacttctctaatactgaaccctatctatttgaaagaccattgtaaagtcagactgtgactaacctcaattcctttcatcttatagattttgcttgcataccccaaatactggatttaaaaggagaaagtattcaacctgaggaagctgataaaaaaagaaaagcaaaaacaattgagaaagtaacaaatacagttgaatttggcaaatatgtattgaatgatgactttttgacaggtacaatagcaaacattagggctatagagttcaatatggtaggatgaaaatctgtattctacattctgagaactctaccttctgataagatatggatattggcaatttgaatagtgtctggaagcatgaaaaagagtagtcatttttttcaaattcactaagtgttcattttggggttcatctaaaaggataaattggggtttggtcatgtaagtaagagaattgagttgtagaattctaccttaacatctctcatacatttttttatccaccttttctcccttagttcaagtggttatcatttagaatactgctatactattataaatcttaacccatgccttggttttgtgaatttccactttagtatctgttctgctggaaggctgacaatgtgcagttatcagagaggagtaattgttacaacaggttacatctcttatgggactatcagtcacctacattgtcacctacattgtagtttgttctaaactattttccagcagtaaaacaactaattgtgattcttgttcgttcttcaaactcaactattgttagtacacatttcctcctagacttttagaaataattgatacaaattttatattttcaaagttctttctgttttaagtttcattcaaaatattttcatgggtgtttggaaaaagaaaaatcaaacaaaattagtagtgatgccattaaagcaaaattatatgtacttgaaaatttctgaatttttaaatgatattctcatgaacttcacatattaattgtatttactcgtggaattattaaaatagtttgacaaatttaaggaggaaagaaagaaaataagacaagaaataaagaaaaaaattcaaaaagtgagagggaaaaagtagtaatcaagtaactaaaatttctacctgcaactttttccaaggtgcttattatcagtgtaggtctaataaaaaaatactgctatgtaaataggcaagttgagacataaataattgattccagatcttacgcagttcacgtggaaagtggtcccaatacaattcaaccttggttgctaataataactttttttttatcaagtgcatggatctctaaaaaagagtataaccccaaatattttctaattcattattgatctctttcaagtagcccctcttggctctacatagcatcagtgcaaatcctattttcctatacccttgtctcaaatgcatagaagactagtatatctaacataaattctcccaacaaaacaaagaaatatccgaaaggtgtaagtctaaagccattcagtatcttgctcactcttccatgaagcagaagaaatgaagtttatgataattgatgaaaaagaatgtgtaataagcaagtaatttgtttcaatgaaactatctgattcattttatttgaggctctttatctagaagaatgtgaccctgaataggatgtataggtgcctcttaaagacagataaattagtgacaatattcaaaattcttaggactgacccatgaattggcccttttttaggtaatacttacatcactacacctgtcaaaggaagaccatgaagtttttgaatctgtggttatttagaggaacttgcagctttttccaaaaccgactttgtttccacggcaacaggaattatctgtcgaagtctgacctttcctttgcatagtttagttttgacagctatgtgtgcgctgttttagaaagcacatataacccagagaatcttaaaaaagatatacaaagtggaaagcaattgaaaatgctaagctttaaaaatacagttaaggttatgaattttttaatatgacttattttaagctagtgttaccttatgtttgaaactcagagctgaaacaagatgtggaaccattttaattaaaattacaggtaaattttgttacataagtaaatattagaaggaagacaaatgcttgtataaggaaacagcttattatgggcattcattaacaatgatctaaatggccgggcaggggggctcactcctgtaatcccagcattttgggaggccgaggtgggcgaatgacatgagatcaggagttaagagaccagcctggccaacatggtgaaaccatgtctctaccaaaaactacaaaaatttgctgggcgtggtggccctcgcctgtagtcccaactactgaggatgctgaggtggcagaatcccttgaatccaggagtcagaggttgcagtgacccgagatcgcgccactgaactccagcctgggcaacagagcgagaccttgtctcaaaaaaataataaataacctacatatataatcatatattggcagtgcacttcacacacattatgttatcataaagatataattaatacaactctagaaagtagatgtcattatcctttttttttttttttttttttgagacggaagtctcgctctatcgccaggctggagtacagtggcgcgatctcggctcaccgcaacctccacctcccgggttcaagccattctcctgcctcagcctcccgagtagctgggactacagtagcgtgcctccattccaggctaattttgtatttttagtagagaaggggtttcaccatgttggccaggatggtctcaatctcttgacctcgtgatccgccctcctctgcatcccaaagtgctgggattacaggtgtgagccaccgcgcccagcctatcctattttttagtggaaaaaggatccatcatgctaaaggatttcccagaatcacctgcatagtatgtaaatactgagttcatgtcttggacattctaaagccacgttcttgtaatttcaaccttttaaattatgaacaaatcaagtaatacaaagcggtaaaaaaattttagctaaaatactaagaatcatctagatttacttaattattaagtatttgttttaaaatagtcatatgtttatcctctgctgcatccaaaaaggtgattttaaaaaatgttcttttggccaggcacggtagctcacgcctataatcccactactttgggaggtcgaggcgggcagatcatcagatcaggagttcgagaccagcctggccaacatagtgaaaccccatctctgctaaaaatacaaacttatctgggtgtggtggtacgggcctgtagtcccagctactcggaaggctgaggcaggagaatcgcttgaacccgggaggtggaggttgcagtgggccaagaccgcgtaccgttgcactccagcctgggtgacagagtgagactccatctcaaaaataaataaataaattaaataaataaataaatagaaataaataagtaaataaataatgttctttttaggttttatatttgtgagaaaaaaatcaatgactaaatcttcagcaatgtggtagtaaatgagagaaatcaatttctttaaacttgatagattagaattttaccagagagaatttcagagaacagataactatgacaattttcattagaattgtatgttcaataaatactgcttaccatcaagtgtaactgagtacaaattataaagacattttagaaaattagatttaattttatttactagggctaacttccaaagaatttataatagaaaatatgaagtcattacaacataaagaaaaatgtttcatgaggaaaaaaagctaaccatctgagatgaccacctcaaacacaagggcaaagaactggaataaaattcagtaatgaatcaagtgtagaataaatgagtatctaaagttagtttgaaagaatggccttgaagaggcttgaagaacaataaaaatgtaatttcatttcttttaataaatagcttttaaagtcctgcattatacaaactaaaaaaagtgatatgttacctaccacttcattttaataatttgacttttattttttcatatttaagaaaaatatgtagacaccatattgacatatttctttttcattccaagtctatttctgatgttatgacttaagtaactatacttatggatcaactttcagaaagctgaaaaatatagaaaatgaaatagggttatgggttgaatttctgcagttgcaagacacagtttgatattttttccctgaagtaaatataacttatattttttaaactccagattcagttttctttaagtttgataactttttgaaagaagtagattatattgttacaggtttgaaaactgacatcacagaaaaggtgctaatgagttattttagtgaagacttggttaaaatgcatgatgacaaggctaggctaaatgggaaaataatatgtagtcagactcagataaatttatctgagccccttttggctcagataaatttggagtgggcaataggaaatttctttaccaaaatattttaataagaaagaatggaaagaaaatcccattagcgctcccaacatttagagattatatttaatactcttaaaactgctttagaaaggaattagaactccttggagaaatgcctgattcacatgaacataaaacattgttttttttgtgcctgaaaatagagatattcaaacaatgggagagacacatcaaaaagatacaggagccagctcaagcaagcaaccactggccaaatcagggacattttgagaatcaagtaggctgcagggaaaagattcaacttgctcagagctgaggtggggaatattttggacaagcttccctcaaattgaggtgtctcatgttgccgttgccttgagttaactctgtatttctggagaagctactctgaggtagctgaaaaatttttgtgggcatatggagaacaaaggagtaacatttattcaagaaaatcttctaaatttgtctaggatagtaaggatctgtggcatttgaaccacaaactaccttcacccccacctccacctctcacccgtccctcataggctccatcttatgaaaaaaaagtactccaggagctctaatataggaaggtgaagccaagaagatgcggtcctctctctcctgcagattccaggtggggccttggtttcaacttgcaggtggagcgaacaggctgtaagaatttctcattccaccctcagccatgttaagtccatgtaagttgtatttcaggcaggtgcggttgagaggacccttgcttcacctagcctttaatcacaagggtgaagctttaccctagatgcaacagaccaagaatactgtattctgttctcttatacaatagctacaagctcactcatagggcataggttacataccaggagaggcaaggcaagaagaccagagccccttccaacctacactctcgaagcagagctgtcactccaggaaatgtaggctactgtccctgtgcccagttctagtgtagtagtgcagaggttctacctatggggagaggtaagctggagaggtcatacctaagggcgaagagctccacagctctacatgagaaaactaattttatttgtaataaattatggaggatttcatgcctaaggattctgctaaaagcaatggagtttttggggaagggcaattaagaagacatatctataactccatgatacaagtattaataagcaaaactgctgagcatcagaattttatcatagagaagcagagaatgagtgagccaagaaggtctatcctgtgatgacagccaacagggttggaagggctgtctatatgctctaaactgtaccttgtcaggagtaatcagggcagaatgtaaagaatatttgaaagaattccttaaccacaacaacgggcatcagcaaagggcagaagtctcagtggcgcaagagcttaagcacaacctctgaccattttctagctaaacaaaaagctattttgacataggggcaactcctagaaaactaagctttaaaatgacattacatgtatccatggcaacctggaagattgtatgtatggccaagatgttgccctccaggagtgaatggagaagtaaaatctaagctactcatacttgcgtgaagacgtggcaaaaacagattcctttgactcttaacagcagcctccacaccacaaatacgttcaatgataaagattaaaaatctaacaggtgaagagggattaagcacaactcctgaataataaatgacctatgctaatccagggacaatacctacataaccaggctgaaatattaaaataagaaaaattctgagcgagtacatcaaaagtcacatggtcgtactgagaaatgactctgcagaaagtctagccattaaacaaataaaatattatttaaatgtttaatggcaactaaatattattaagcaaataaatacatggccaatgaaaaagctacaacataacctggggtgaatgggatcagcaacatgcggtgctaccatatattatctgaaaggctgcatttgcaacgtaaaattttgagatgcacagaaacagagataatcataaccatatacagaaaaagcagataatagaaacttatttggaaatggtctagatactgcagttatcacagactttaaatcagccactataaatatattcaaagaactaagaaaccgtgtctaaaaaaaattaaagaaaaatggcaataatgttccatgaatagaaagagagagaaattgttttttggagaaccgcatgaaaattttatagttgaaaatgcaataatcaaaatgaaatattcactaaattggctcaacagtagatttgagttgacaaaggaaagaatcagcaaacttgatgatagagcaatacaggttatgtaatcggaagaagatagagaaaaaagaataagaataaatgaagtgagccacagagaaaagtaagacaccaataagtaccccaacaaaggtataatggaaaaaccatgaagaagagaaagaaaagggcagaaaaatattccaagaatgactgaaaactttctacatttgatgaaaaacattgatcagataatttaagaattttgatgaactctaaatattttaagcacaaagaaatccacacttagacatagtcaaaatgttgatgccaaagacaaagtcttgaaggcagtcagagagaaaaatgacttgtgatatacaagggaatcccaaaaagtttaaaaactgaattctcatgagaagcaacagaagccaaaaggcaaagatataatatatttaaagtgctaaaatgaaaaaaactgtcaactaagtatctcatattcatcaatattatctttaataaatgaagataaagacattctcagaaaaacaaaatttgaggaatttattgctggcagactcacaagaaaatattaaaaagaattcttcaggcttaaagctaatgaaactgggtagtaataaaaaaacacattaaaaaataaaaaatttccaataatggtaattatgtaagtataaaggacagtataattggataattattactattcattttcttaactcatttaaggaatagttgcataaaatacatgtatataattggattgttgggtttaaaacattagacaataatatatttgacaataacagcacagaggaggtgggtaggagaaaagttgtatagagtaagaaataacacagacagcaactataattcaatggaagaaatacaaagaataaaaaatggtaaataaaaggtacatgtaacaattctacaaacacatactctctctcctttcttttttcgagttttttaagagatataagattatataaaataataactataacaatgtattattgagttcataacatataatgacctaatatgtacttcattatgtatatgtaccacattttcttcatccattcatctatcagtgtaacatttaggttgcctccaaatcttggctattgtgaatagtgctgcaataatcatgggagtgtggatatctctactaattttatttcctttcgatcaatatccagtagtgggattgctcgatcatatggtagttccatcttttgttatttgatgaaccttcatactgttctccatagtagttgcactaatttacattccccccaacagtgtatgaggggtctcttttctccacatcttcaccattttttaaatcacatgtcttttggataaaagccttttttttttttttttggagatggagtttcactctctcagccaggctggagtgcagtggtgcgaccttggctcactgcaacctctgcctcccaggttcaagtgattctcctgcctcaccctcctgagtagctgggattacaggtgcatgccaccatgcctggctaatttttgtatttttagtagagacggggtttcaccatattggccagggctggtcttgaactcttgatctcatgatctgcccaccacagcctcccaaagtgctaggattacaggcatgagccaccatgcccggtggataaaagccattctaggtggtgtaaaatgatacctcattttgttttgatttgcatttctctaacaaacaataatgttgagcaccttttcatatacttattggcaatttgtatgtcttcttttgagaaatgctcattcaagtcttttgccaattttgtaattggattattcctttttttcttataaagttgttcgagcttcttatatactctgattattaatctcttgtctgatgggtagtttgtaaatattttctcccattttgtggattgtctcctcactttattgattattttctttgttgtgcaaaagctttttaacttgatgtaatcccatttgtccatttttgctttgattgactgtgcttgtggggtattactcaagaaatatttgccaagtccaatgtcttggagattttcctcaatttttcttttgctgttgcttcataatttgaggtcttacatttaaatctttaacccactttgatacgatttttgtctatggagagaggggtctagtttctttctgctacatatagatatctagtttccccagcaccatctatggaagagactgtcctttccccagtgtaggttcttggcaactttggcaaaaatgagttcattatagatgtaaagatttgtttctgggtttttttttaatcttgttccactgttctatgtgtctgtttttatgccagtaccttgttgttttgattactatggctctgttttataatttgaagtcacataatgtgattgattcccccagtttcgttctttttgcttaggatagctttggctattctgggtcttttgtggttccatgcaaattttaggattatttcttctatttctgtgaagaatgttcttggtattttgataaggattgcattgaatttgtagtttgctttgggtagtgatgtagtttggatgtgtgctcctgcctaaatctcatattgaaatatgatccccagtgttggaggtagggcctggtgggaggtgattgaaacatgcggatggatttctcatgaataattaccatcatccctcttggtacacttctcacaataattctcatgagattttgtcaattaaaagtgttagcacctccccagttgctctctcttgctcctgctcttgccaggtgacatgcttgcttccccttcaccttacaccataactgcaattttcctgaggcttctccaaaaaccaagcagatgccagtgtcatgcttcctatatagcctgcagaatcattagacaattaaatctcttttctttatgaattaccccatctcttttctctttatagcagtgcaagaatggaataatagaggtagtatggacattttaacaatactgattcttccaatccatggatatggaataccttgccatttttggtattttctttagtttctttcatccatgttttatagttttattgtagggagctttcacttgtttatttaagttaattcctaggtatttaattttatttgtaactttggtaaataggattactttcttgatttcattttcagattgtttgctgttgacatatagaaatgccatttattttattatgttgattttgtatcctgcagctttactgaaattgtttattcattctaaaatatttttgctggagtcttaacgattttccaaatataagattatatcatttgcaaacaaggataatttgacttctttcttttcaatttgtatatgctctacttctttttttttttctgattgttaatctaagacttccagtactattccgaataacagtggtgaaaatgaacacccttgttatattctagatcctagaggaaaggctttcagtatttccccagtcaatatgatattagctatgtttgtgacatatatggcttttattatgctgagatatattccttctataaccagttttttgcttgtttttttaattatgaaaagatgttgaattttatcaaatcctctttcagtatcagttaaaataatcatatggttttctatccttcattattttgatatgatgtatcacattgattgatttgcatacattgaaccatccctgcatcccaggatagatctgatttggtcatgagtgatctttttaatgtggtgttgaattcagtttgctaatattttgtcaacgattttgcgtcaatattcatcatggatattggtttgtagttttctttttttggtgtgtgtttgtctgggtttggtatcaaggtaatatttgctttgtagaatgagtgcagaggtattatctcctcctctattttgcagaacagtctgagtaggattggtattagttcttctctaattgtttgatagaattcagcagtaaaaccttcaggtcccaagtttttctttgctgcaagatttttaattatggttcaggttttgaatttcttcatgattcaatactggtaagttgcttctatttggccatctttctgtgcttccattctatgttctagtttttattttttgaggaatttccatactgttgttcataatggttgcactaatttataatacattctcaacaacagtgtgcaagtgttcccttttctctacatcttcatcaacttatcttttgtctttttgataatactgaattacagaggtatgaagcaatatatcattgtggttttgatttgcatttcccgaatgattagtgatgttcagcaccttttcatatacctattggtcatttgtatgctttccttagtgaaatatcttcaggatcttctttcctcatttttaagctgggttatttgaattttttgttattgagttatatgagttgattatatattttgaatactagctccacattagatatatggtttgcacatattttcttccattctgtaggtttccctttcactattttgattgtttcctttgctgtgcagaaactttttagtttgacatgatcttacttatctgttttttgctattgttgcctgtgtttttgatgtgattaccaaaaaattatttcccagaccaatgtcaaggagctttacccgtatgttttctcttagtagctttatagcttcagtttttatgtttaagtctgtaatccatttttagttgatttttgcatgtggtgtgagataagggtataatttattcttcagcatatggatagacaattttttgaacattatttatggatcagattatcttttcttttctttgtgttctcagcatccttgtcaaatatcagctgaccataaatgtttgcttttatttctgggatctctcttctggtctttatattttttgataacttaatattgttgagatggtaaagatcctgaaatttatctacattcaatatgattattatctaaataccagtttaccttttaacagaaattgacaactgatcttaaaactcatataaaatgcaagaaaactaaaataggctaacaaatcttgaaaaagaacaaagttggaggactcacatttgtggatttcaaaatttagtacatagctgcagtaataaatgcatcgtgatactgacacaaatataaatatagatcagtggaacaaagtttaacatacaaaattaaactcatatttatggtgaacttatgtatttaaaattattatgattttaaataaagataccttgataattgagtaagaaaagagcaattgtttcaacatgcggtgctgggaagtgaattagagactaaatgtaagacctaaaactataaaactcttagaaaaaaagataagagtgaatctttgtgaacttgcattaggcagctgtttctttgatatgatattgaaagcataagaggctagagatataatagataaattggacttcttcaatattaaaacctttatattgcatgatactataataaaatggataaaccacagaataggagaaaatatttataaattgcatatctgataagagactgatatccagactacaaaaagaacatccttaactcaataataaaaaggcatgtaaaccaaattccaaaatcagtaatgaatttgaatagaaatttctcaaaaggggaaaaacagatgacaaataagcatggggcaaagattcctaataccattagtcattaagaaaatccaaatcaaaattacaatgtgatagcatctctggtctgatagcaatgaaacagtctttttaaagtgcatctgagcatcagcttcagtgtgagaacttgaggtgatggtatactacccttttgtgtacaatatattctttatatcaatattcattatacagctctatttcccaaagtgtagactacatatgtctgacactcctggtaatgtacttggggaatttttttttctttctatttaatattaggctctgtagttctaaaggatttgattcttagaatgccactacttccagtgggggactcagcaccatccccactaaatttaaaacatccttttcaccttgggctcctgtgactgttaactagcaggcaaggaaaagagttaacacactgccagtgtttactgactttcatcatcatgagaagtatgtctcttattacataatgggggcagcaagaaaaacatagaatatttaaatgatgaattacgtactcactttaacagttttaccttcaaatggttaaggataaaaacaatggcttgatacagacataataattgggaattcagtcaccttaggtatgatggccttctttatcccaccagacaaggcacccacaccaacagaagttttcctggaaggaacaggaatttagaattggtggtaaaatagggagaggctgagcattaacaagagccttgagatcaaggattccaaaaaccctcctcttgaaacttcccctagatagtgtgtctgaagaatcctagagaaactgtgcccagattgaatgaactaatttgagaagtaagatgggttcagcagtgcaagcaatagactctagtagatgtcatggtgtcatatccacatcccatccattgccagtgtatctggacccctagctgcagtgaatgtaagcctctgatggcttacagcttcagtctggaaaagtgctattatcaaagggaatcaattcaccagaaaaggcatgaaaacgaatgccttttacccagaggtggcttgcagaaaataacttactgatacatagtacgaaaagctaactcggtctggagtttggacaactctgattctgagtttctcacttaatttatctggaggtaggacatcaatagaagtacatagttgaatagttctttgccccagttctaacccgctttccaaagttttttgttttttgttttttgtttttttttttttacagatttctcgtaagagccttccttcagtaatcacttacaccaggatttcatgtcaagcactgcttcaagagatcctagcccaggacatccacccctcaaaagactgcgtctctcagacttaacaaataaataatcatactttgtgtagtaaagaaatattttaacaaatgaatacagagtgtttggaaatgaagtaatgcacaaagatataccacgcaaatatgaacaaaaaagatgcttttgtaacaattttaagcccaagtaaaaagccaatagataccaatgaagaaatgaatagtgttatgtttatacaaggttcattgagcaataaaatactagtcacgttgaagtgtctctgaatgaagaatcaggttaataatagctgattctatgtttttcaaatgtcattgatgctaattattttatttcacagacattatattcttcactcccactttcaaatttgaggatttccacagatctctaagagcaattggtgaaagcaaattgtgtatcaagtccttctcagtgattcaggaagtttagacaactgttttattccaaattaaagtgtgaaacttgcacagctctaattgtgttagcttgggctaattatttcatatttctgagtcttactttaatcatctttaaaataaaaaaagtcctaaattataatatgttgaaaaccacacataaaatctcttaaaggactatcttaatctctcagcaatacctgctctttttatcttcctctctctccttttcctccctcttcttttttatcttcctccctctccttttttaaaatgtagaagccactatattttatgtaattttaattctaaaattttaatattctaaaatgatatcctagtagaacagtgagaaagaatgaaataatttcattttatttcaaaaagaatttcagtatttaaaatgcctccaacattatgattgttattgaccctgatgttgattgaaatatgaaagggcagaattacacattcagatgtaatggaacttccttacgttacacaaattagaaactatatcaaagagaatgtttagattttgttgtaatattttcagaaagataataaaatatttccatgtgtcagcaagaagacaaagaaatatctctagtatgcccataccataatcctgtttcctccaaaatcctcagaaaaagatagtgaaggaaaattgctttattttccaaatgtcatagaattatataagctaatgaaataaaactgttcatgttgtaaaaaaatgcattatcgccttttggaaaaatcctcttaggacccaatgtttctcattgaccctgccccttatcaaaaatagcaataacagcaaataccagtactccaggtaattctgactataaacagtgccagaatttttatcaagtgcgtaattcttaccttaaggaatcacttaagccccctccaaataccaagtttctttgttggaaataactaatggctaccaagatacagctttcattgtgtttttccccatggtaatgaaactgaattaccagactgtttgaaattataggcaaaatagaacttttaaaaaatattcatgattgatttgaactaaataaaaatactgcttaactcatagcaccatttctttctttcctttttttttttttttgagttgttagagtcttattctatcacccgggctggagtacagtggtgctatctcagctcactgcaacctctgcctcctggcttaagcagttctcctgcctcagcatcctgagtagctgagattacaggtgcaccaccacacccagctaattttgtatttttagtagagacagggtttcacaatgttgcccaggctggtctcgaactcctggcctcaagttatccgatttcattttttagatctcattaagtaaaaaaacaaataaatatgtgtttatgtatgtcacagttggtgtagaaaaagtatgggcttaacaaaaaactaagattgaatcctggttctctctcttataagctgattgatcttgtagcaatttaattaacctctttaaacctcagttctcctgggttaaatgtaaataattaaatgtattgcattattgacaaaagaacaaaaaagaaaaagcaaatcaactgtcatggtgttttaaaaatagtctataactatttgtctttttcttctatactataatcaacatatggcaccttattggaaggagatagaataatatgtatgtttatattatgctttattatattatgtttagaagatatattgttttaatgggaaggtataacaggataaacactcccaattttctctcattaagcttaaacctctctttcaagctctatatttgtgtatcaattgtcttttccaaatcttcacttggctgtctctaagatatttcatacctaatacaactatgctgaactactaatttcaccccttcccaattccctttcatagtagcttcttttcctcacggacatttccaaattatttaatagcaccagcattcactcagtcacatgtcagtcctgaggaacctgtgactctcccttaccctcacctctaatctatccaatctcggttgtttttatgctatttcacaaaaacctgtgccatctacttctgtctttcacttctgatggatattaccaatgcttttcatctggagggctgcaataccctcctgttttcatctctatcttaccactatcaatttcattttccacacggcaaccaatatgataattttaaagcacaaaatgttttgttgccctcttgcttaaaaccatcaaatggcttccctttccacttaaaagtaatagccatgcttccacacgtggtccagcagacaccttgtgttcgagacccaacctgcctctcccatctcttcctacgccactctccccatattgattgtgtatcattcacaagaggatcttgggtctttaactttttttctttttaatttttgtgtgcacatagtaagtgtatatatttatgggttatataaaatatttttatacaggtatgcaatatgtaataatcacatcagagcacatggggtaaccattaccccacacattaatccaaacaaaccaattatatccttttagttatttttaaatgtacaattaaattatttttgactatagttaccctgttgtggtagcaaatattaggtcttattcattctttctaactatttttttgtacccattaaaaatccccactcccctccaccccaccttccctgactacccttcccagcctttggtaactatccctctactctctgtctccatgagtgcaattattttaatttttagctcccataaataagtgaaaacatgtaaaatttgttttctgtgcctggcttatttcacttcacacaatgaccttcagttccatctatgttgttgtaaatgttgaatttggtcaaatgatttttgatctcgtatttcatggctgaatagtacttcatcgtgtatacagtgtttcctttatccatccatctgttgatggccacaggttgcttccaaatcttggctactgtgaacagtgctacaacaaacataggcgtgcaggtatctcttcaatatacagatttcctttcttttggatatatacctagaggtgggatttctggattatatggtagctctatgtttagcttttttgaggaacctccaaactgttctccatagtagttctactaatttacattcccactaacattgtacaagagttttcattttttccacatcctcttcagcattcgttatcttttttcttttggataaaagtcattttaactggggcgagattatgtctgattatagttttcatttgcatgtctttgatgatcaattatactgagcaccttttcatatacctgtttgccatttgtatgtcttcttttcagaaatgtctgtttaggtcttttgcccatttttttgaatcaaatttttagattttttttttctgcaaagttgtttgattccttatatattctggttgctaaactcttgtcagatgggtagtttgcaaatattttctcatattctgtgggttgtcttttcacattgttgattgttttctttgctatgcagaagctttttaacttgatgtgatcccatttgtccaccttttttccttttgttacttgtacttgtggtacttgtgagttatcactcaagaaatctttgcccagtccaatatcctggagtgtttccccaatgttttcttgcagtagtttaatagtttgagatcttagatttaaatctttaacccattttgatttaatattttatatgatgagagacagggtctactttcattttttttatttgcatgtggattttcagttttctaagcatcaattattaaagagactgccatttttcctatgcatattattggctcctttgtcaaaaatgagttcatgtaaagatttatctctgggttctctattttgttccactgatctgtgtgtctgtttttatgccagtaccatgctgttttgcttactatagttccgtagtataatttgaagtcaggttatatgattcccccagttttgttgtttttgcttaggatagctttgggtattctttgtattttgtggttccatattaggattttttgtctatttctgtgaagaatgtcattggcattttgatagggattgtataaaatctatagattgctttgggtagagtatggatactttaataatattgaacatggagtatctttccagttttgatgtctttttcaatttttttcatcaatgtcttatacttttttgcagacatctttcacctgtttagttaattcctaggtattttatttaatttgtatctatgtaaatgggatgactttcttgattccttttttggtttgtttgctgttgatatatagaaatgctactcacttttgtatgttgattttggaaatttgttcatccattctaagagcttttttatggagtctttaggtatttccaaatacaagatcattttgtctgcaaacaaggataattttacttcctttccaatttggatgctctttatttctttctcttatctgacagctctagctaagactttcagtactatattgaataacagtggtgaaagcgggcatccttgtgttgctgatgttagaggaaaggctttcaatttttcccctattcagtcactagctatgcatgtatcatatatggcttttattatgctttttattatggttcctcctatacccagttttttgagggtttttatcataaagagatgttgaattttgtcaaatgatttttcagaatcagttgaaatgaccatattgtctttgttcttcagtctgttgatatgatgtatcacacattgattaatttgcagatgttgaaacatccttgcttccctgtggtaaatctcattttgtcacgatgaatgacattttttatgtgttgttgaattcagtttcctattattttgttaaggattttcttgcatcaatatttgtcagtgatattggcctattgttttcttttttttgatgtatctggttttggtatgaggataatactggccttgaagaatgagtttgaaggtattccctcctattctattttttggaatagtttgagtaggattggtatttgttcttctttagttgtttggtagaattcagcagtgaaggcattggtcccagtcttttctttgttgggagactttttattataacttcaatcttgttacttgttattgacctgttcaggttatggatttattcatggctcagtcttgtagctagtttgtatgtgtctaggaatttatacatttcttctagattttccaatttattggcatatagttgctcatattaatgaccttctgaacttctgtggtatcagttttaatgtttcctttttcatctctgattttatttgggcattctttctttgttttttagttagtctagctaaaggtttgtcaattttgtttatattttgaaaaaaacacctttttgttcagttgatcttttgtattactttcatcatttcaaatccatttatttctgctttgatatatattttctcttctagaaactgtatgtttggctgaaacatttttatacatgctattccttctgcctgaaaatctttaattggcttcttctcaactttcaagtctcatttaaatttcttctaaaagcctttgctagcaacccaactcacatcataccccccctttcttcctctcaaaacgctttgtgatttctcttgctattgcttactcagatatattcttatatgcatgtaaaggagtatttgattcctccttactttttttctcttctaggcaaggaacaattctttagtatgacacaataaaaagaaaaaaaaattatggcatatatgtttattcattcaaacaaagaacaaatggacagtattaaaaatggagctggtcagaggcagcagctcttttgtatgtattaatcagggaaggactttgagctgaaataatatttaacagagatatgaatgaaccaagagagagagccaaaagaaagtacataccagggagggaaacacaaacaaagttcctgagacaaagatatttttggtgcatttgagaaatagtaaggtcagacagcataaaaaagagaaaaggggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccaccgcactccagcctgggcgacagagcgagactccgtctcaaaaaaaaaaaaaaaaaaaaaaagagaaaagctagaaaggagggtcaagttgggtccagattgcatagagcattataggttatagcctgggctttggttttcattctagcatcaaaattattttattagggtcagtcaattttgtttttctcgtgttttttttagtctgaaaaagtgatccagcaatcctactactaggtatctactcagaggaaaagaagtcattatacaagaaagatatttgcacatacatatttatcgcagcacaattttcaattgcaaaattgtggaaccaacccacatgcccatcagtcaagaagtgtataaagaaattgtgattttatatatatatatatatatatacacacacacacacacaccaatacacataccatatatatctatatatatatattatatatatatatttatgatggaataccactcaatcgtaaaaatgaatgaattaatggcatttgcagtgacctggatgagattggagactattattctaagtgaagtaactcaggaatggaaaacgaaacattgtatgctctcactgatgtctgggagctaagctatgaggacacaaaagcataagaatgatgcaatgacgcaatggactttggggacttaaggggaaggatgggaaaggggcaagggataaaagactacaaataggttgcagcaaatactgctcaggtgatgggtgcaccaaaatctcacaaatcaccactaaagaacttacccatgtaaccaaataccacctgtacctcaataaactattggaggataataaaaaaaattgaagacctaatatattcttcaatatggagaagccactgctgctaattctagagtcaaagaggaggcccagaatatgaaaaaatctaggctgcatctgggaccctgaagaggggtgcagagagagcaaaagataaaaggaatggttaaaagaagtagcaaaggaagaggttagagtgtaaaagaaaatattttgagatgctatctggcctggcctcagtgtagtaagatagataattagtggggacagtaagagaatatttttgcagtacccttctaactcattgtgagtttacagtcatcgaataatatttatttctgtgcatttgctagacagtacaagaacatatattatgagttaaatgtgaggaaaatttttgtcaatatgtgatgtgatgtctgaccttgtatgaatcatgacaaaccataccaggccaggaacataacaccatgctccctaaactacaggaaaaatggtgcacagagtgaataaagccagtaggggccatcctggaattagaaataccatctcagaaggaatccagcatggtggaaacaaatggccaatgaagattgatatagagtttagtgggaaaatttggagctacagtcagtagtgaaggaaaaggcatagctccagggttagtgagaaattctgaatctggttctctagtgaaggaaaaacatgaatagttaattgattgtgaatgaaatgaatacaacctcaaaaataaaactagataccaatgtctgatgacacaaaatttgcagagggaacaagtgttacaaaatgtgatgcagtttcaattttgtttagtgaaatcattgaccatcagaagcctatttagaacggattcagacccccaaaagtaatgctatttttgtgcatcaagttcaattctggacagcttatgaaacgattttagtttttgtaggaaacatttcacttgtttctccctggcacgtcctatttgggccctgaatgctaaaaaagatactgtgagagaaatgactgccaacccccagctccaactctgatccaggaggagattttgagagtatactgtcatgggaaataatgaaaaaaaatttaaaaatctaggaattctttttatctcagcccaagatatttgaacttcattcaatatgctgagatatctctgaccagaatgtaagaggcagcatacaggttaaacataaagctgcatgcataaaatagaaaaaaatgttcttggttttctttccatttctgtgtttctgagggagcatgattttctctttggcctctgttttagggtatttgacaaagatatacaggaacaagttcaccccatttgagattaaactgaggagcaaattccagtgcatttatagactggtttgaactctgtaagcccgtgtgtggttcgtggtgtttaaggtagcatagttctttccctccctaacagaaaatgagaattttttttctttgtaaaagctaaggaatttcaataaaaggatagagtggcatgacaggattttcatttttcctttttctttcttctagcttttccctgatgaagagggggcttgggatacatgtataacaaaataacaaagaccttatggccaactcactcaccaaaataatgctatggtcagcaggatctagttttttccagcaaggcacctggtctttcttgtccctggaaaaaggaaccagaaatacattccagaaagtatgctccttggaacaaagtctaattttcaaattaatggaaagtacaagatggttcagaaagtaaccaaagggaaataacaaaggaacatatgatgagatagattaaaggggttcatactggccaaatatgagaatatttgatcactaaaacacttaatgatatagtagatgatcttaactcactgggtataacaaacttcatgaataaagaaatttgagataaaaggactaataaattataacagaagttgaatgacacctgataaatataggaagaatgatgacaataggaaatcatcaatggaagctaaaactgaggaaaaatgtaatgagaaacaggatagtttcacagtctcaacacattacctcaaatattatgattaattacaaagtggaaaactgtatctttacattgaaaaaacctgacagacacaatcttaagcaaagttaccaaagttaaccgatattgaaacatttcaacatcatgtgcctcagatataatagatataatgtactgagaaggatccacctttaacttaatggcacgccttccaaaaatgcttgacttgaatctaattataggacaaaggcccaatttagtaaaaatattttctaaatgtctggtttctacatttcaaaaattgcaaggccaagaaacttaggaaaggctaagatactatttcaggttaaagaaggctaaacaaatataacaaccaagtgcagttctagattggttcttggaccaggaaaaataaagttactataaaatacgtaattgatacacttgataaatttgattatgatatgtgggtataccatggaaatatattaatgctaaaattttctgattttattatactgtggacatgtgagaaaatatcctgccattttccataaaatagtacatactgaaacatttagtagcaaaaagatacaatatctccaaacttttctcacatgttcaggaaaaaatcgtctgtctctctctaaatataaatgcatatatatgcaaatgggtcaaaatgtgacaatagattatgaatctaataagaggtacctgaggatttcctacattattcctgtatcttttctgttaggattatatcaaaataaaaagttaaattaagctatatgtattccaaacatcttgaaaactatatagggctgtaaattttcaataattaagcttatgttttttttccataaaagacatcttcataaaagagagggtaccaaaacgtgaaaactgttaaaacatagcttaatttttattttcaacaatgaaaccctaatcagaagcttgcatattttttcatttttatatttatttgttttcactttctgtttatactgatgtaatatatgaatgttaacataaagcaacgattttaattttcattgcttcctctttttctacctttatactctgatttttttcaacaacttactttcttctcaatgaatgaaaatgaataggttttaataaaccactgaatttatatctagaagttttggtttagattaggctttgtcttcaacctaatatccattgacttgatatcctaggactcgtgccaacacttatatgttagtagtcaaatattttttctattaatattcctgtgttttatagaataaatggaaactttcttattaaaagcttagattctttggattggaatcaaatatgctcatcaaaacaaagaaattttaatacttttaaaataattaaatttatttttagttattaaaataaattttaataattttaataatttttgtgtcttataagctttaaaaatcaatttagctatataagcataaatgaaaggctgatcaagctcttaatcaaattcatatttgaaatgctaatatttgaataagcatgtgtggacatattgcaaatagaaaatgtactcttatttgcaaacaacctctatgacattttaaaatgaaagcagcattctatgaaatctgatgactatgtattaagcaaataagtctccagaatctgtttcgactttgtatacatgtatttgtgtgatttgttcaaccaatgttgtataccaactttctattgctcataataaatcttgcagaacatgattttttgagacacctcaatattaaaatgactgaaaaaatttaatgcttttcatttatgctttttattcaccttggaacatatctggctgcatatagttttcggcctttatgctgaggtagaaattttaagagtaatcagttaaattcacaatgaagctcccattttttttttttgcactttcatatgcaaggagagaatttttgttcatttatattttctggaaaaaatgtgattttcatataattaaataagttgacattaatataaactgggtaatatgacatagtaaataatttaaggtacaatttaaatcatttaaatagtcttcatctggcatcaagtcattttaaacttgcattactgtagatatgcttgcttagagacatcataaggaataaaaactgtggccttaaagtaaaccattacgaactttaagtacattaagggaaacaactttcttcaggtcaaagtttgttaaagaaagcacactatcacattagttactctaaggctaattatgataactcatacgacccttaactaaaaagttgacacaggtgtcctttttatcaccaagagaaagaaagatcctgaatcttttcccaaggaaaaattgagtttctcccctaaatatagctggatgaacatgtttccaaaattaaagtgagaacaatatcaagctatcagtaaaactttcgtatagattttgattggctttatttaaaatgttcatattatttttatgaattacatacaagctttaactgacttaataaaaatactccagctttaaagtaagagaacatcatctggatctttttaatctgactaaagatacaaaacaagtgtttggtagtttaattctcagaaaccttaaagacaaaataaagtactggtttcttgcattatttgatgtatgtataacccaagtatattccagatcttattcctggtaaccaggatcattcaaaaagttatgacataaatttcccagctcttgtttctatttgttcatggaggacagccacacaactacaaagtcttccaaagatgccatataatcctcgcctatctcattgaatttatgtgcacagttcaggacacactacttttgccaaccatattggtatccataatgtcaataccaatatgcattcaaggacctctcataattttttctgttgtgttacccatggcatgaatctcaaattgcaattgtctcatattcatgcatgttttttaaattgtctgtctctcgttttatagtacaagactaatgatacattttgtttctggttcatggttgtatccatacatcttagtataatagtaggtgttcagtgaatggtgatatagtagcagtagaaaaataataataataacaaaacttcaatagtttttcattgcctaaaagacaatatgcaaattccttaacatcaaataaggcttttaacaagtgactatgacccaccttcttggctcctctcaagtcatagcccttccttaaatcaaatggtcatgaaagcaaactaaacattgtttccagagcacccctgcacttccataccttcaggtctttaaccagggaatattttctgggattattcttcatatcgtcatttcagaccaggtagtatacagcattcaaagttcacagtctcctttttaaaaaagaatccctccatgccccaaatagtacttatcactcttcactctgtggtctcctgatgtgaatatacagcttgtttgtccccttaaatattaattattgatgcccttaatatttccccttcccaaattaatagaacataataagaatatctgaggtcccttaattctctgtaacatagataccttttataatgggttttagtatttgtgggcatcagatttgtaaaggtgacaatggccaggaatggtaatcttctatttatcacacaccacatgagatactttgcatatcaaataatcagtcattagaacatagtgtttgaattgtgggtaaaggtcacttgagaaatcatctatgcagctgcactaatataattgaattgatattctacttagaaaagcattgttcaagctccagttacacttaggcttctctgggatcctagtgaataataattacattcttgcctttgctcactttatgttggctcacttgatatgtcacctgtttcacctttcatgcagcccattaactgtcttgagaattccaatgaacagtgttcagattcttctctttaatattttctacagccattctgttattttagtttccattaattttcactattctatccagaaactttacaatctcctcggtgattttcctgtctcttttctacctttgcttcatccatcaacaaccctttgtttcttatctttgccttaacaatgtacacaatgtacacaatgaaattattttcatgacacagttggaatcctcctgttttatatctcaatcaatatagactgaatgctccataaggtctttctgggacacatgcacctttgagaaaaaccttttaaattgaattatagttgcttaagacattttcttaagacaaaataatggtgcttcttacaaatatatgcttggcattctagctattttctcaaatgtcaagtaatttactccttcccgttatttttttctttgtactaattgaaatgttaattttctttcttaattgcttaaaatccaaagagactctacccattaaaactgcaatacaaatggaatggaaagtactgttactagtactcaggctttgcaaatacataccaatgtattcctgtccaccaataagatgtctttacattattcccaacatcatataaaataatggactctttctttttgccttcttagtgccctcagatagaagtcataatttagccttcccaaatttctgatctaaaattatggaagtggaagatttaagttgtaaattatctgatattccatataatcattctaggaaaaagcccctttggaacagagttgttgaacacttcgcatgtcatatgaaagagagtcatagctactgatgatttgttttttaaaaataactcaatgatggccgggtgcggtggcttacacctgtaatcacaggactttgggaggctgaggaaggggatcacaaggtcaggagatagagataatcctggccaacatggtgaaaccccgtctctactaaaagtacaaaaattagctgggtgcggtggtgcgtccctctaatcccagctactctggaggctaggcacgagcagagcttgaacacaggaggtagaggttgcagtgagccaagatcacgccattgcattccagcctgggcaacaagagtgaaactccatctcaaaataataataataataataataataataatgcaatgacaataatttatttttaaggattattatatgagcagaagagagttttaacaatcatctaggcccactgaatacaatcatagacaagaaattgactgcctcaaacagtaacacatttgagttttgaatttctgtggttgatgtagtcctgattggtctcttttttttttttttttttgagatggagtttcactcttgttgtgcaatggagtgcaatggcacaatcttgactcactgcaacctctgcctgccgggttcaaatgattctcctgcctcagcctcccgagtagctgggacaacaggcatgcgccacaaggcccggctaattttgtatttttagtagatacaaggtttttccatgttggtcaggctggtctcaaactcctgacttcaggcaatccacctgcctcagcctcccaaagtgctggatatcaggcgtaagccaccggacctggccaattagcctcttttatatcaagtcttatcctgaaagtgaaaaaataataatacattctttttttaatggtttcttgtcatttgattattgtgctcactttcagaagtcatcctattgacagtatttctttaataatttagtttacagaattaagtatagtatatgcagtataactaatgcaacatagtctcttggatttaggcaatgctggctgacttaagaaaaaataacaaaagttggagggataaaaactaactaaaaattttgaggggctcaagaaaacaagccagtaggaattaacagagtgtttttaggagttgtcattaaaataagtttcaattgtcttctctccttgttcctgagctcaagattcagtttcaaagactattggccctgtctgtgtttatttgccaatcctcttagcttggtgcaataagtcaggcattttcatggaaattattaaagacaaagatcatttgtaaaaagactgattaccaaagactattactatggaagaggaaaagaatgttacccagaataagacaaccaatgcctgattcagcaggcccagaccctctagcctttctgcctgtgagcaagtacctatatcagtctggccttgtgagcacccctggttgtttctaaaccagaagattatgatgacagagtgctgctttcacctcagataagagttaaattttctaatcctttaatatttcggtaaatttttttccttactgggctttcatcagtgttttaccagtatgaattttgaagaaagataaatatactgacagacaaatgcatacatacatagattgatcacatggttggtggagaatgcaagtacatcactctttgcacttttatgtattttctaaatctttcttaataaaatgcattttaacacgtttagacactgtggcatagtaaaggatgccctaaatatcttttattttatttttgatttcaaattttattttatattcaggaggtacatgtgcaggcttgttacatgatacactgcatggttcagaggtttgggatatgtttgatcttgttattgggtattgagcatagtacccaacaggtatttttttcaaccatttcccactctctgtcttccccttctagtagtccccagtttctatagttcctgtctttgtgtccacgtgtacccaatgtttaactcccacttataagtgagaatatgcagtgtttggttttctgttcctatgcttagaataataccctccagctgcatccttgttgctgcaaaggacatgattctattctttttcatggctgtgtggtcttctatgttgtatatgtatcacattttctttgtccaggccaccatggatgggaacctaggttgattccatgtcttcactattgagtagtgctgtgttcacatacgagtgcatgtacctttttggtagaacaacttattgttcttgggtatatacccagtaatgggactcctaggttgaatggtagttctattttgagttctttgagaaacctcaaagatgcttctcacatcattagtagttgaactaacttacattcccaccagcagtgtataggtgtgttcccttttctccacagcctcagcagtatgtttttttttttttttgacttttcaataacagccattctgactcatgtgagatagtatctcattgtggttttgatttgcatttctctgatgattactgatgtggagcattttaaatatgttggttagctgcttatatgtcttcagaagtatctgtttatgtcctttgcccactttttgatggataatttggtttttgcttgttcaatgtttaagttccttatagattctagatattagacctttgtcagaaacatagtctgtgaatagtttctcccactctttaggctgtttgctctgttgttaatttcttttgttgtgcagaaactctttagctttattaggtctcattggtcattttgttgttgttgttgttgcaattgcttttgaggacttagtcataaattatttgccaatgtcaatgtccagaatggtatttcctaggttttcttctaggattttatagttttaggtgttatatttgtgtctttaatctatcttgagttaataatttgtatatggcgagaggtaggagccaagtttcattcttctgcatgtggctaggcagttatcccagtactatttattgaataggatgtcctttccccattgcttatttttgtcaaatttgttgaagattagatgattgtagctgtgcagctttatttctgggttctctattctgttctattggtctgtgtgcctgtgtctactaaactatttttgtttgtttgttttttgagacggattctcgctctgtcacccaggctggagtgcagtggcacgatctcggctcactgcaagctccgcctcccgggttcacgccattctcctgcctcagcttcctgaggagctgggactacaggtgccagccaccacacctggctaattttttgtatttttagtagagatggggtttcaccgtgttagccaggatgttctcgatcgcctgaccctatgatccgcccgcctcggcctcccgaaatgctgggattacaggcgtgagccatcgcgcctggccaactaattttatatatgtgtccatgtgtgtatggatacgtgtatacatattattcccagaggtgttaataggtataaggttttaaaaagttccatcatcaaaatgtttataatatactgcatattttagcaccttcctggagctccacaatttatattaacatattaaaggctttccatattcctgatgttaagctttgcaagtcagatgggattgaatttaattctaccttacacagtttttaatgtgtgtgactttggcctatttatgccatcttcttaaagttcagttttctcaactcaactttaaggtgataccaacaccttcagtttaaatgataagatcacaatcttaatcatacagacctgagttcagatcttagttcttacacataatctcttaattactacccttccacatttcaatgtacttagtgtatataacagagataatactattaaggtaattcttagtgttttggaagaattaagttagataattatgtacagatattaacactgtccatggcacattagcctttatttttttattatttaaatatttcattgtattttaagttctaggatgcaagtgcaggatgtgcacgtttgtcacacaggtaaatgtgtgccatagtggtttgctgcacctatcaaaccatcacctaggtattaagccccacatgcattagctatttatcctgatgctctctttgccctcgccctgctgacaggccccagtgtgtgttgttcccctccctgtgtccatgtgttctcattgttcagctcccacttgtaagtgagaacattcagtgtttgtttggttttctgttcctgtgttagtttgctgaggataatggcttaaagccccatccatgtccatgcaaaggacatgatcttattcctttttatgactgcatagtattccatggtgtatatgaatcacattttcttgatccagtctatcactgatggacatttgggttgattccatgtttttgctaatgtgaatagtgctggaattaacatatgtgttcatgtgtctttataacagaatcatttatattcctttgggtatattcccagtaacgggattgctgggtcaaatggtatttctggttctaggtctttgaggaattgccacactgtcttccccaatggttgacctaatttacattcccaccaacagtgtaaaagcgttcttatttctccacagcctttccagcatatgttgtttcctgcagccatcactggagctccagtctgccatttttcccctgtgggtgccggggagactggacagtttggaggaattccccacagcgcagcgcagcacagcacagtgacacactattgctagactgcctctttagtgtttattgtctggtaactattatcattgtcattactattgagatgtttgagatgtgctaaattgatactaaatgagtatataagctcttacggtgagtgacatagtgaatgtttagtagcgtctactgccagtgtggtggtggtagaagaggattaaaaataacaatggaggtgtttcatttatttaaatactttcagatcaaacttttccaatcttcctataatgcacagaatttgaggacattatcacctattcctagatgcgctggaacagcccacaagcttttaattttttaggagaaccttggtagaaattatttgggtccacctctgagtgaatatctgtggccttctggtcaggcacctgtcctttttaggcccctcacatttcatagtggttgttaatctcaccttctgtttcattgattgttgtagcatatggcttagcacaaactggcagcacaaaatagctgcattccaaatatttgttaggaagtgtgaccttgacagtgatgactgataaaagttggattaaaagaacattttgatcagatcttttttagtgacatgtttaaatctctccctggataaatcaaagaatcagagtttttaaaattttatgatgagattttatttactccttttccctacatccatataggttttttaaaattaattgagctatgagtttttgaaatttatttatatatttacttttaaattgttgttgaagatagatagcattcagtacattgtgaattttttaacaaaaattttctctgtggtttctgtacctggaatatttgaaatactttgagccacagtttgtctacaactcatgaacaccgtaaatctggtatttgggccatgctgcatttttaattctgattgctaaaaatattcaaatcatttttttaccatcttcccctttcataaatgtatagacacttattatatgcattttgtatgatatgttaacattacttctggcattatgttaacctgaataaattagtcttttacatttttatttttcttgtatttttaattttacaatattttggtgacctataaagacaatatattcaaggatatcatgtgaagatatatatatatatatatatatatatatacacacacacacacacacacacacattgtgtaatgattaccacaatcaaattaattaacacatctatcaccacccatgctgttcattagatcctcaggattcattcatcttataactgaaagttataccctttaaccaacattaccctgtttccctcaatccatagacactgacaaccccactctactctctgcttctctgagtttgacttcttcagatacacataaaagtgagatcataccaatttactatttaatacttattaagtatgatgtatgtacagaaacataactcataaatgtataacttaattaattagcacactgggaacatgcctgtggaatggcactcagaatgagaactgggacagtaccagcagtgcagatgctcccagaatctcccttaatccataccactctcttcttaaagtcaatcaatcaatcaatatcttgatttttaacatcataattaacagagagcatatgaatggaactttatggtctataactccatattatgtttatattattcttccgtgctattgtatgtagcagtggatttacttttattactataaaaatatatttttaaaaaactcttcacatctgcagatatcagatctttgacaaagttgagaaaaataagcaatggagaaaggacacactttgcaataaatggtgttgggatagatggctagtcacatgcagaaaaatgaaactgggccctaacttttactatatacaaaaattcactcaagatgtattaaagatttaaatctaagacctaaaattacaagaatcccagaagaaaacctaggaaacaccatcctggacattgtctttgggaaagaatttatgactaagtcctcaaaagcaatgagaacaaatataaaaattgacaagtgagacctaataaaaccaaggaaattctgtacagcagaagaaactatcaatacagtaaaaaaacaacctacagaataggagaaatattgtattaggccattctaacattgctataaacaaatacttgacacaataatttacaaagaaaagaggtttaattggtcatggttcttcaagctttacagggagcataatgctgacatagccgtagcttccgagatggcttcagaaagcttgcaatcatagcagaaggcaaaaggggaacaagtgtatcacgtggtgaaagcgggagcaagagaggcagagtgggaggtgacgcacacatttaaacaaccatatcttgtgagaattcactcagtattgtgggggcaacaccaagtggatggtgcctaaccattcatgagaaactcaaccccatgatccagtcacctccaacctggccccagccccaatgctggggaatagaattcaacatgagatttgagtgagtacacatatctaaactgcatcaaatattcacaaactatgctttctacaaaagtctaatatccagagtctataaggaacttaaatgttgaataagcaaaatacaaatatcccattaaaaaatgagcaaaagacatgaagagacacttcttaagagaagacatacaagcaggcaacaaacatatgaaaaagggctcttcatcactaatcatcagagaaatgaaatcaaaaccacaatgagataccatctcacatgtgtcagatggctattactaaaaagttgaaaaacaacagatgccggtgaggtggagaaaagggaattcttatacactgctggtgggaatgtaaattagttcaggcactgtggaaagcagtttgaagatttctcaaagaacgtaaaacagaactaccttttgacttagcaaccttattacggggtatatacccaaaataaaataagtcattctaccaaaaatacaaatgcacttgtatgttcattgcagcactattcacaatagcaaagacatggagccaacataggtgcccatcaatggtggattggatgaagaaaacatggtacatatacaacatggaaggctgcgcagccataaaaaagaaaaaaatcatatcatttggagcaacatggatgcagctggaggctattatccaaacaaaataacacaggaacagaaaactagataccgcatgttctcacttataagtgacgtggagacacgtgtttgtagagacagcaacaatagaagctggtgactactagagagaggaagcagggaaaagaagaagggttgaaaaactattgagtactatgctcagtacctggatgatggaatcaatcatactccaaacctcagcctcatgcagtatacccaggtaacaaacctgcacatataccccatgaatctaaaataaaaattgaaactataaaataaaatgaaatattaatcagtgtacagttatttaatactttccatctggacaataaaaggacattaaatcatgaatctatttacagtctgcaaattttttaaaatggaaaatatatttgtataaaaatattgggatatttagacaggcctcgagtggacaagctaatgaaattttataacctgaagacacctctgtatgcatttttagattgaaaaacacaacattgtcagtctctccacatcagacacttttgccttttccaagcactactatggtatagatcatctgtacttttcagctcttttgtagtttatatatatagaatcatatagtatgaatattgtgtatgtagatttaaaattccatatgtttggaaatttgtctgtatctttgcatgctgttgtggttaattcattagaattggtgatagaattctatcatctgaacatcaaacaattaatttagttatttcactgcaaatgcacatattagtggtatttatttgggggcttttagaagtactgattgtatgtaaattttattttactgacatataggaaaatttattttgagtgaatacgtagtaatcaaattgttggatcacaggtttacattttgaataattttttacactgcaaaaataaataaataatgaatagataagaaaataaaaaaataaaaactcaaacccgtattcattcttccattaaaagaacatgagctcatacatctttctgttgaactagcccttatatcatcatatgttacaccatatctctaataatatgttttactttaaagtttgctcttttggacagctttttaaaattaatctttgcataatatatattttctatacttttatttcagcctatctgtaatcttcttataatcaacatatttatgccaacttttcctgaacatttcatattttaattagtgctttagtccattcaataattgtatttatctctaatatcttactatttgtttactgttttcccaactatccttcctttactcctccctttattgctatttttgtattattttatgtagtattttatttttcttctctacacaactttttatagccattgattcatcaagtctgacatattagtacttggttcacatcatgaacaatgcaaagatattgaaactcaattacatttgatacttttccatattttgtgctgtaatttttatagatcttaactatctgttttaagctagatagatacaatagtatgttattttcacttagccatttatttacttttaaaattcaattatctttatccttttctgaatactcatgttttcacttggaaatattgtttctatgaccgcagtttagtgttctctttaatgtgtgttcatgggtgatagattttctcaattttttgtttgcctaaaacagtctctattttgccttaatttataaaggataatttttgctgtatgtagaagtccatattgaaagttattttctttctgcagttaaagctataattctattttggtttccactgtttcttttgagaaattacctgtcagtattaatactcttcttttgaaggtttatgttcttatccttcagactccttttaaaattgtctctttgtctttggttttcagtagcctgattatgaggtgtctaggtatattttaatgcctatgtgtatttgtaggtggatttagacttggtgttcatattctttctgaatgtctcttgtcagctttggaaaattctcagccattatacatttaaaaagtgctctgtccctttctatacctcctctatttctgactgtcaagctacatgtatttaattctttacacctgtctctgtgtgtcttattcttttttcctattgtccatcatttaatttcagtaattttgagtttagttctaaacttccatttatttaaaatttctatttatttatttaattctccatcctatcatttaatttcgtaaacatagtaattgttgttagtttaaattccatgtctgataactacaagatctgtatctgtttttgacctttctccatgttactcttttctcttgattttcatccaagttttatcatttttcatgtctagttattttgatttacttgtggatgttatgtataaaaaattgtagagacaacttgggaccttgtttaatgccatcttctctataatatttactttggttcccaatctttttccagttatagattgagatgatgcaaagctcgactttagtctttgtgagggctggtctatttccattttatctcatactcaggtgtggccctttgaaggtttcaaatgcaaaccttggatgtttcccagagctccttctccttggtagactctatgtacacttttcctttcatgcagacctatgcaagttcaaaaagtaataattatgcttttggactcttaacttatttgctgccactattgaatctttgaatcctttaatggaaaaagcaatgtctaatgttgggctcaactccctgggctctgctgtgctgtgtaaggtcttgacccttacctctctaatgcctcttcaaacaggcaagggggtgtgtgtgtgtgtatgtgttacattttgtctacatttttcttttttttttttttttgaggtggagttttgctcttgttgcccaggttggagtgcaatggcatgatctcaactaactgcaacctccgctatctgggttcaagcaattctcctgcttcagcctcctgagtaactgggattacaggcatgcaccatcatgcctggctaatttttgtattttcaggtgaaacggggtttcaccatgttcgttaggctggtcttgaactcctgacctcaggtgatccacctgcctcggcctcccaaagtgctgcgattacaggtgtgagccaccccgcccagccttgtctacatttttctaagttggtctcagtaggaagataagtcagaaacttacaaatccattattcctagcagatgcagatatcaactcattttcacacacctaaaatttattagtttttgtaagcttcctaaaatctttttgcaatattactagctttttgcctatcttggttatgtgcacactttaacaaatctaattataaaatctctttcttgaatgagaatggagaagcaaaataatggtcctacatttgtattctctctgcactaagcaatggcttgtctctttcttggttttcttctgtctctgttcctaaaataaacatctgctggataaaaactccaggctttcattatgttttgcctctgtgagttttcccttagattatctgcccatttgctactttcctttttcttcctgtgagtaatagcatctatcacttctcttctaatttcttactgtctcctgttttggattattacttctccagtttactttattactgagaagcattttcttatgctctatttctctaaaacaattgtgcaattactttgataaattttagtttaaaaaaataataaccacaaaaatagaggtcactaaaaatatacctaagaagtattataaggattttgtaaagtaatcaagttgtccctgaactttattaaaatataagtctaatttgaccttggaataagccttcttagactgttttttttccctcctcagtttctgtagatatttataagttattcttataaaatagtttctcattttattctggaattagaacacctgaatcttttcatgatttttaatggaagtatgtcttgtatataggctgtcatttttgaggtcctttcttgcacaatgaaatcaagaactttcaattacatcttaaattaagctgaggttttaatctcaatttcagtcctgacaatgaaataaatgacaacttgaatttttgtctcgctgtgtcgcccaggctggagtgctgtggcgcgatctctgctcactgcaagctctgccttccaggttcatgctattctcctgcctcagcctcccgagtagctgggactacaggagcccgtcaccacgcccagctaatttgtttttttttttttttttttttttttttttttgtatttttagtagaaacggggtttcaccgtgttagccaggatggtctcgatctcctaacctcatgatcagcccacctgctgggattacaggtgtgagccaccacgcctggccacaacttgagttctttatatggaaatctgttcttagcatttgtaataaacttcagttactttgttactacaatcctgtccaaatttgtacagttttatataaccaatcatttctattctagttagctgttcctaagtgacatcttctgaatttgacctcttatggtaaacttgaaaattgctgaaagtagattttaaatgttctcatcacaaaatagtggcaattatgtgaggtgatggataggttaattagttttatttaatcatttcacaatggacacatatattaaaaccatattccacactattaatatatagaattctgcatttgtcaactaaaaattaataatacttttttagaaagctgagcttgccaggacattccatgcagaagtctgataatctatattatattgatgtccacttctcttctccttccttgacaggatttgtgaatattcaatatatatttattcaaataatgcttaccaaataactgctaagtaccaagcactgttctttgtcttaataaagtctatattttggtaattatataatcataatatagattttgagtcttgcaaaaacaaacattgattgagtctgacacatacagtgtgagtgtgatcgagaagtcaaaggagaataaaatcacgtccctaaaattaagaaactcataatataaaagagacagaaatgtgtatatagttttttgaaactcttaaatatgcactgaaaaatgtgtgcagaaactattctgaacaaggaaggtgcagtgactaactggatcttagaagaagacaaaaaagactgtatgaaaacaaaaatattagaaatcttgaaggaaaaatagaatttggcaattagataagttggtgtgggaagacattccaaatagagggaatttccagaggcacagagatgacacagagcaagacctgtttaggagattacaagtgcaaaatgcctggaagagagatttatgaattttctacatgtgcatgtatgttatgtatgtagtgggttgatggtggcatgtatgtatatttctagggattaagtgggacattggggtagttgacagactggtgaaatatttggcaagaccagtccaataagtgcctgaagtgtctggctaggagcttcagactattttgtaaatgggaaacctgaaaaattttaaagcccaacatcaaaaatgcatttttcagaaacataaattttctatgatgagataagtttgaaaattacccttaaaatcttccagtgttccttcctaacatttactgtgcaagccagacagtgatgaatgttacctttcacagctatttcagacagtttagtgatatgattagtatctccaaatgtttccatcactttcactttacctaccagaatttcctttttttgtgagaattgttcacaaaagcagttctgttaacttttgcttgctcttctgtgataacattgtcagtaaagaaacaccagcatttatcagattttctactttgagtagaatgaaaatagtagcccttatctagattaaagttcatatatatatatatatatatatatatatatatatatatatatatacacacacacacacagtatgaggacactggtgtaaggtgtttttcaagcaattttttactaatgagagtttatgtatgagtttgaaagttacatgtgatagaaaagttacagtgactaaaggttttccttctaattatatcaattttactcatgtttacgtagggtaaatctagcaatctaaaaattgtacatacctgcagacagttttatccaggtcagactccagagtgatatgccactaccagctgaacagaaactattaaattgcttaacttaccaagagtattttgtggagtttattaaagcctgaaagggttttctcattccttcactactcatacatttatttattagttctcggtttgttgcaatggatggatagctttctcctctttgcatttatttaaggattctttaaattgtttagtgtgctataatctgttactatgttttgatactcgaagtactgataaattggccagtagaggcacttcaagctaactcttctgttcttttaataggcctacatcattgtttgagtatttccttgtttctggcagaccaagatgttccaaggggttttggtactccccctgaaccagccttgaatcagaattctgcttactttcagttggtttagaaattaaatctgggttctgagagctaaatatgctcactgctcttagggtgtcagtgattctccaccctctaagaggactaagccggccaggcgtgatgtcatcccagcactttgggaggccgaggtggcctgatcacctgaggtcaggagttcgagaccagcctgaccaacatggcgaaaccccgtctctattaaaaatacaaaaattagctggacatggtggtatgtgcctgtaatcccagctacttggaaggctgaggcaggagaatagcttgagcctgggaagcggaggttgcagtgagcagggatcacaccattgcactccatcctgggctacagaacgagactcctcaaagcaaaaaaaaaaaaaaaaaaaaaaaggactaagccaagaaatacatgtatacttatgtatgcgtgtgattgtttgtatgtgtgtgcgttcataaatgcatgcacatccacacacaaggtacctttgatccccctccatttttgtatttataactcccttctctgaagtgagaaacatagcttctattgcatatatttacttgtttgctcaatcttagaatactcatactttctgaagagtctatgcataccatgactcaataccaggctctcaatgccatatattttcaccatttcactatttcaacacctttccactaatttttctagctttcagtctcttccaattcactcttcaatttttttggcatcattctgaacacactagtctttttggcatcattctgaacacactagtcttaaaaaatttcatatgttgctactatcaatagcaaattacttagtcagatattactaatgtgacattttcacctggctttattttacatttaaaaataatcaattcctatttcttatgtagactctatgttgacctacaacattttgttttttccttgactggacacctatctctcttttggaacttatagtagcttctctagaaatatttcttaacaatcccatttattatgatccctccccctgccaaatcatatagctgactccacattttaaagttttagccacttttctcacatgactttgtattattgacatttgtgtctaggggtctatcacagtacatttctatgataataggtgattagtaaaaagggttgtacaaaggatttaaacttttatactcccaattatcttctcatgtcaagtatcttgcttttaactggaatatccagtaattcctaaagtaattaaatagactatcttaattttgaaaaagattatattgccaagtgaggcttaatttaaatatttacaacattaattaattcattctacatatactagctttaaaattatcaactagaggtcaatttcttttaaaataatataatggaatatttcaatataaatgaaattattttataataaaaaatgaaagagaatgtttacattttattaaaatatgaaatgttttcataaatcttttatgtccaccctttgttttgttttacagcactaactctatttgattgctgtttttttaaaaaaaaatgattcattcatttctggcagcctttaatttgcctctgctattcttcacatttttctcattttttcttctgcctttttatcacctagtgtaaaatcaatgcaatcacttgaaaagcaaaatcaaggacagcagcttattaaaaggaggaacagagcaatgccatttgatgctaaactacctactttcaactccaaagctcagaagttgacagataaacattttaattccttaatcctatttattgtcttcagagttcattggttctgaagtaactaaaataaactttattttagctgcaggaagttttaaaagaaatatagttatgaatactattattgtagtctcaaaaatgtggttattatcttttttagtattaaagaaactatggaattagaatgttgaatttaaccttttggtttcacacaactaccttaactatctgcttatcttcatttcttaccctaacttatctagaattatactacattacatagcactagtaactttaaccacagacaaactaatttacctacattttaccttcaatatagccatacggttttgttgaccttcatgaagagagaaatctgagccatattcctcatcattagtttgttataataagcatttttatctccagactcttaccaatgtgtcagtcacacctaaaaactggacctataagaaaggaaaataatttctaaaatatccagcattataggtattaaattgctttaaagtaatatattagaaggggtggagcaagatggaagaatagaggagtccaccattgtccccctacaaatacactaatattacaactatccacacacaaaaagcatcttcataagaaccaaaaatcaggtgagcactcacagtagctggttttaactctacattactgaaagaggcattgaagagggtaggaaagatagtcttaaattgccaatgcgctgcctccccaatcttgtagtggtgaccatagtggccatgtggcatggagagagagtctgtgtgattgggggaaagagagtgcagcaattgtgagacgttgcattgaactcagtgctgccctgtcacagcagaaagcaaaacttagctgaactcacctgatgcctgcccacaaagggagcatgtaaaccagccctagccagaggaatattacccatcccagcaatcaaaacttgaattctgacaagcctagccactgtgggctacagtgctttgaggccttacatattccttaaaggcagtcttgtccacaagggctgcaactcctaggcaagtcttagtgctgaattgggctcaaagtgagtggacttggggggcacatgacctagtgagatgccagccagggtggctaagacagtgcttgtgctacccctgccctaaccccatacagcatggctcatagctccaaaagagagcccgtctttctgcttgaggaagggagagggaacagcaaagaagactttgtcttgcatcttggttaccagctcagccacagcaggatagtgcacccatcagagctgtgaggccctggttcctgaatgacatttctagacataacctgtgctagaagggaatccactgtcttgaaggaaacgacttagtccttctaggaaccatcacccactgactgaaaagcccttgggccctgaataaccagcagtgatacccaggtaatacgccatgggccttggacaagactgtgacacttgctggcttcaggtgagactcagcatattcccagctatgatgactacagggagaggcttcttccacttgagtaaatcagaaggaaaataaggggaactttgtcttgcacaggtgggtagagcaccaagcatgctcttggggtccccaatttcaggccttggctcgtgaacagcatttccggatctgccctaggccaaaggggagccaactgctctaaagaatgaatcccaggcctaccagcattcaccacaagctgactgaaagaccttgggccttgaagggaacactggtggtagccttgcagttcccccaatgggcttatagtagtagtggccatggggtgaggcttctctacctgtggaaatggaatggaagagtggaaaggacagcagctcatagtttgagtcacagctcagccacagtacaatagaacatcacgagacttctaaggttttttacactcgtccctggctcctggacagcacctctggacctgtcagggaccagggggaatttgccaccctgaagggaaggatacaagactggctggctttaccagttgctgactagtgccacagggccttgagtgaacataggtggtatccaggtagtaactaccgcaggccttgggtgagaaccagtgctgttctagcttctggtgggacccagtgcagtcccagtggtagtggccacagtggtgattgtgtcacccaacccccagctccacaaggctcagacagagaaagagaggctccatttgattggagaaaataaagtaacagaacaagagtttatgcctggtgattcagataattcttccagaccttatccaagaccatcaaggtaatacctctatgagtttgcaggaaccacagtgttactgggcatggagtgtcccgaatgtagatacagcttagctcataacaccgaagtcctttcaaataccttgaaagccttcccaaaaaagtcaggtacaaacaagcccagacttcaaagacaacaataaatacccaactcttcaatgctgagacacaggtgaacatctaaaaatatcaagactatcgagaaaagataaactcaccaaatgaactaaataaggcaccaggattaatcctggaataacagatatgatttttcagacagagaatttaaaataactgttttgaggaaatgcatacaaattcaaggtaacacagaagataaattcagaattatagtcaataaatttaacaaggagattgaaataattaaaaagaatcaaacacaaattcttgagttgaaaaataaaatggtcatattaaagaatatatcagagtcttagtagcagaattgatcaagcagaaaaagaaaggattcatgagcttgaagacaggctctttgaaagtactgagtcagaggagacgaaagaagaataaaaaacaaagaaatatatttacaggatctagaaattagcctcaaaagggcaaattaaagaggtattggccttataaaggaggtagagaaagagaaaggggcataaagtttatttaaataaataataacaggaattttcccaaacttagagcaaggtatcaatatccaaatacaagaaggttgtagaacatcaaggacatttaacccaaagcagactagttcaaggcatttaataatcaaaccctcaaaggtcaaggataaagaaagaatcctaaaaatagcaaaagaaaagaaacaaataacatataataaagctccaatgcatctagaaaacttacatgccaagaaagagtgtcatgatatatttaaagtgatgaagcaaaaaaagttttaccctagagttgtatatctagtgaaaatatccttcaaacatgagggagaaataaagactttcccagatgaacaaatgctaaagaatttcatcaatgcctgttctgtcctacaaaaattgctaaagggaacactttaataagaaagaaaaggacattaatgcacaataagaaatcacctgaaggtataaaactcactgataatagtaaatacacagaaaaacacaggatatgataacacggtaactgtggtgtgcaaactactaatatctgaagaagaaagactaaaagatgaactgatcaaaataactataacaactcatgacatagaaactaaaataaagtataaatagaaacaaaaatttaaaaagcaccaatacaaagctaaggtggagagactttttaggtttcttttctgcttgtcggtttgtttatgcaaacagtattatgttgttataagctgaaaataatgggttttaagatagtatttgcaagcctcatggtaacctcaaatgaaaaaatatacaacagatatacaaaaaataaaagcaagaaattaaataataccaccagagaaaccaccttcactaaaaggaagataagaaggatgagaaggccacaaaacaatcaaaaaacaaataatcaaatagcaggagttagtccttacttatcaataataacattgaaagcaaatggactacacttttcaataaaaaacagagtggctgaatgaatttttaaaataagaccgaaagatctgttgcctacaagaaacacaccacctatataaacacatagactaaaaataaagaaatggaagaaagatattccatgccaatggaaagcaaagcagagcagaagtagctatttttgtagaagacaaaatagatttcaagacgaaaactgtaaaaacagacaaagaaggtcactatataataataaagggtcaattcaacaaagggacataacaattgtaaatatatatgaacccagccagcactggagcacatgcacacagacacacagacacacacacacacatatatatatatataaaacatatatatataacaaatatgactagagctaaagagagagataggccccaatacagtaatagttggcaacttcaacatcatacattcaagattggacaaatattccagacagaaaatcagcaaataaactggacttaatctgtactatagatcaaatggacataagagatacagaacatttcattcaatggcagcaaaatgcacattcttttcctcagcatatggatcattctcaaggacagactatatgttaggccacaaaataagtcttaaaacattcaaaaatattgaaataatatcaagcatcttctctgaccacgatggaatagaactagaaatcaataacaacaggaattttggaaatgatgcaaatacatagaaattaacaatatgcttttgaaagaccagtgggtcaatgaagaatttaagaaggaaataaaaaaatttcttgcaacaaacgataatggaaacacaacatacaaagtctaagggatacagcaaaagcagtactaacagggaattttatagctataagtgcctacatcaacaaagaaaaaaaatcaaataacctgtttcattttaaagaactagaaaagtaagagcaaatcaagcccaaaattagaaaaagaaataataaaggtcagagcaaaaataaatgaaattgaaatgaataaaataaaacaaagatcaatgaaaccaaatgtttgttttttgaaaagataaacaaaattgacaaacctttggccagactaagaaataaagagagaagccccaaataaataaaactagagaagaaaaaggagacattacaactgatactgcagaacttcaaaggatcattagtggccactatgagcaactatatgccaataaattggaaaacttgaagaatgaataaatttctaggcacatacaacgtaccaagattgaaccatgaaaaaatacaaaacttgaacagaccaatagcaagtaatgagatcaaagccataataaaaagcctctcagcaatgaaaagctcaggacctaaagacttcactgctgaatttcaccaaacattaaaagaaaagctaataccaattctgctcaaactattttgaaagtgagaaaaatagagaatactttcaaactcattctacaagatcagtgttaccctgatactgaaaccagaagaagacccatttaaaaaaagaaaactatagaccaatttcactgatgaatattgatgcaaaaatcctcaaaaaagtactagggaactgaattcaatgatatattaaaaagataaattaaaaagatatttcaccatgaccaagtgggattttatctctctgatccaagaatggctcaacatatgccaatcaatcaatgtgatacatcatataaacagaatgaaggacaaaaaccatatgatcatttcaattgatgctaaaaaagcatttgataaaattcaacatctcttcatgataaaaacccaaaaaagctgggtatagaaggaatataactatgcataataaaagtcatatatgacagacccacaagtatcagactgaatgaggaaaaactgaaagccttctttttaagatctgaacacaacaaggatgcctgctgtaaccactgatattctacatagtactgcaagttctagctagagcaatcagacaagagacacaaagggcatccaattagaaatgaaaaagtcaaattatccttgtttgtagataatataatattatatttcaaaaacctaaagacttcagcaaaatgagaattgataaacaagttcattgaagttgcaggatacaaaatctacgtataaaaatagcatttctatatgccaacagcaagcaatctgaaaaataaatgaagaaagtaatccaatttacaatatctacgaataaaattaaatacctagtcattaacctaaacaaaccaagtgaaagatctctacaaggaaaactgtaaaccactgatgcaagaaattggagacaccaaaaaaatggaaaaatattccatgttcatggactgaaagaatcaatattgttaaaatgtttatactagccaaaggaatctacagatttagtgcaatcctgataaaaattccaataatattcttcacagaaatagaatcctaagattgatatggaaccatgaaagatccaatatagccaatgctatcctaagcaaacagaacaaaactgtataaatcacaatacatgacttcaaattacaacacagagttatagtaaccaaaacagcataaaactgccattaaaacagacacatagatcagtggaatataatagagaaccaagagataaatacatgcatctacactgaactcatttttgacaaaggcattaaggacatacgttggggaaaggacagtgatatggtttggctgtgtccttgcccaaatctcaacttgaattgtatctcccagaattcctacatgttgtgggagggacccaggggcaggtaattgaaccatgggggccagtcttacccatgctattctcgtgatagtgaataagtctcatgagatctgatgggtttatcaggggtttccgcttttgcttctttctcattttctcttgctcccaccgtgtaagaagtgccttacacctcctgctatgatcctaaggtctccccagccatgtgaaactgtaagtccaattaaacctctttttcttcccagtctcagttatgtctttatcagcagcgtcaatacagactcatatagtaaattggtaccgagagtcagatgttgctgaaaagatacccaaaaatgtgaaagcattggaattgggtagcaggcagagattggaacagtttgaaaggctcagaaaaagacaggaaaatatgggaaagcttggaacttcctagagacttgttgaatggctttgcccaaaatgctgatagcaatatggacaataaaattcaggctgaggtggtctcagatggagatgaggaacttgttgggaactggagcaaaggtgactcgtcatgttttagcaaagagagtgttggtggcattttacccctgccctagagacttgtggaactttgaacttgagaaagatgattcagtgtatctggcagaagaaatttctaagcagcaaagcattcaagaggtaactgttaaaggcattcagaagtagagcattaagtttgcaaaatttgcagtctgactatatgataaaaaagaaaaacccattttctggggagaaattcaagtcggctgcagaaatttgcataagtagaaaggggcctaatgttaatccccaagaccatggggaaactgtctccaggtcatgtcagagaccttcacagcagcccctaccatcacaggccccaaggcccaggaggaaaaactggtttcatgggccaggcccagggttcttgtgctgtgtgcagcagagggacttggcgctctgggttccagccactccagccattgctgaaaggggcctacgtacagcttgggctgtggcttcagagggtggaagcctcaagccttcgcagcttccacgtgttgagcctgcaggtgcacagaagtcaagaattgaggtttgggaacctccatctaggtttcagaagctgtatggaaatgcctggatgtgtaagcaaaagtttgctgcaggggcaaggccctcatgaagaacctctgctagggcagtgcagaaaggaaatgtggggttggagcccccacacctagtctctactggggcactaccttgtggaactgtgagaagagcgccaccatcctctagaacccagaatggtagatccaccaactgcttgcactgtgcacctaaaaaagctgcagatgttcaatgccagcccctgaaagcagccaggaaggaggttgtaccctgcaaagccacaggggtggagctgcccaagaaaatgagaacccacctttgcattagtgtgacctggatgtgagacctggagtcaaaggagatcattttgtagctttaaaatttgacttcccctctggattttggatttgcatgggccttgtaacccctttgtttcagccaatttctctcatttggaacagctgtatttacctaatgcctgtatcaccattgtatctaggaagtaactagcttgcttttgatttttggaggggtgagggatggaatgatatagttcggctgtgtccccaaccaaatctcaacttgaattttctctctcagaattcctatgtgctgtgggagggacccagggggaggtcatttaatcatgggggccggtctttctcatgctatacttgtgatagtgaataagtctcatgaggtctgatgggtttaacggggttttttgcttttgcttcttcctcattttctcttgctgctgccatgtaagaagtgcctttcacctcctgccatgcttctgaggtctccccagccatgtggaactataagtccaattaaacctctttttctttccagtctcgggtatgtcttgtaaaattaactattttgtatgccttatgttgaaattcataggaaaacttatcttctgtaaatgacttttggaaaggaatttgttcaaccatctctaagcattacacatgcctgtgcttgtccactggattgaaagcagagagaaggaggtgagggggtgatggtcaaggccaaaacacacatttagaagatacctcagattataaccattgttatgtgtgtgcaattttatttaacactgctgtgtacatgaacaagttacataaaatgtctagtctttctagatatttggaagtgcttgatgtatttaatagtaacagaatgacatgttttgcaaaaagcttttaaaagctgatgggaaatgctgtttggaagtggaattgttgaaccacctctgtgaacagcatactttatgtacctgttcattggattgaggaatgtggaagggaagaaattgaaaaaggtgttttgccagtgtttattagaaaatttcagcttaatccattgcctatatattacatgcatttcatttaactttgctatactgtatatattgtgtatatattagacaaatgggtctttattttataacatctaatctctatatattaaagaggttgccaatatttaaaaaaattaatcaattatagaacaaaagaaaatacagaaatgacaaatatccaacaaaaatatagtattgaaaagggaaaataaaattaagcagaaaagaaaaaagaagaaaataataaatatagaacgaagccaagaagatccaatgcaaacttggaattcctgaaaggaagaaaacaaacgaacaaacaaaaacaatgggattgaaaataattcagaaagccaaattggggataatctctttaaaaataacaaagtttggctaggcacagtggctcatgcctataatctcagcactttgggagtctgaggcaagtggattgcttgagctcaagagtttgagaccagcctgggcaacatggttaaaccctgtatctacaaaaacaaatttttaaataaggatttttaaagaaacattgattcagatagtcaacaataagatttgataaaatctgataagattattgaaattttaagagaaaaaacatggcctcttggatccagacaaagcatcaagtcacttaaaagggaaaggaaattgaaagtacatttttcttttcaaagtttgcagactatgccagatgccaatgcagcaaatgcatttaaaatacctaaggaaataatacatgaaaacagaattttatatatactgatgatggcagcggcggcctgtctagagtggccactgccatgacgccgggtacagtgagagaggtgcagctggggctggatgctccatggagccggcgagagctgggaacaggcagaagcccccgcttctgagttggcagtgtgggagcttcacatttcctgggcacagctgcagcctcccagctgaggctgtggatctgggcatccccatgctcttaatgtctgtgagcaggcaggagccccaccttcctgggcgcaactgtagccactcaagccacggctgtggacctaggcatctctgcactctcgggggcccgagaaggccccttcccccacaggctcacaagtgcctgctcctgctgcctggcttctccccactcccagtgccgactctgatctcagagcagaggccaagccctggtgctgtcacaacgcagccaggtgtgcacatgctcagggcagcactgacacactagcccccgacccctgggccccctctggaatttgggcaccaatgagcagcatataaaggaggcctggggggctgagggcagcttggcactggcctgcaggcatccctcagcacaaccaacctggttgccatgaatagcagcaggaggcagacaggctcctgggtggaaaggggcaagtccctggttaagtcccaccttcaagccagggaatacctgaagcctagggtttagactgccagtccagcaggccagagtaggaatttatggtacttttctgggcccatccatggctgcccatggaccagtcagcatgcacttcctctcctctgaagctaataaaaatcccagagtcagccagatttaaaaagagatgtcaggacaaacagctgcagagaggagctatccactccagggtctcttctctgctgagaactgagcagacaatcaggatgaccagatgtggagaggagctacccactccggagtgacctctctgctgagaactgaacacttgtcaggccaccctggctgtggagaggagctacccactgtgagtctcctctgagctgttctatcactcaataaaattcctcttcaccttgctcaccttccacttgtccatgtacctcattcttcccaggcacaggacaagaactcgggatccacctaatgacagggctgcaaaagctgtaacacaagcagggctgaaacacgtcctttgcttgccacattgcaggcaacaagaaggagaaaagagctgtggcccttcggggaccccagacctaagagctccccaagtcagggctgtgacaccctctttggggctgtgcagtttctggcatctccaagcttctggtcaccaacgtgttctgcagtgccagtcgtggaagctgctagcaggacacctggtccagctgcagccttgcagggagctggcacccatgccagtgcctggagctgcccatcctgcttcagccagcatgcttggctgtgcacagtggctgtactctatgcttgctcactaacatatccctcaccattctgcttgcccttggcagggatgggatccaggccagcagtgagagccaagcacagcctaccaggcagagtgggctcagtgggcctgagcagaacttgggcaacggtgtcactgggcacagaggtttctggctgctaaggcaacacccaaggatcccgtaacactgagactgaatttcatgccagatgaaaataaaaagctactacatgtaaatgtgcaataaatcagtgaatatgtttctgatccatgctttctgaacaatctatcactgaaacctcttcaaacagacaagacatgtttagaaaagtctgcataatgaatgctattgagcattgaatatatttatctttacaaataacaaaaagctatctatatcaaagtgattagaaagatattatagatggattgttataataaaattatcccaaatcaaggtataggtgagagaaatcttagtagagaaagctcactaatatcttctaagtgttaacgaggagttagataatatttccttaagcaagaatcttggagaggggaaggaaagtggaagaaacagtttattagaaaattgcaaaattgttcattgtgctatactaatggatgatatctatttaaaaagagaggactaagtatatactttaaagctattagtaaaagtttgtgattagaacaaatgcaaatcattataaatatcaaattaaagtttttaaaaagattacattttatttttcaaaggagcaattattgaggattttgaggggaataattccatcacttctaattcaatatggaaggattaaagagggaaatagtcttggcagggaaatttggttctgtaatattgatgcaaaggaatctcacttttcattggtatactattccttaatagtattacagggttgtatttcccaatattttgtgtttcttctattggtgtctatgaggaaaaagtttccatagttctcttatatcattacatttatcttataagcttatcatattatggcttataaaaataacttctaaacttttattctgtcagctctggaaaagtttaaacaacactgggcaatttcttttttttatgctgggttttattgttatgtttatttattttttttattatactttaagttctagggtacatgtgcacaacgtgcagccttgttatatgtgtatacatgtgccatgttggtgtgctgtacccattaactcgtcatttacattaggtatttctcttaatgctatccctccctgctcccccgaccccaggacaggctccagtgtgtgttccccaccctgtgtccaagtgttctcattattcatttcccacctatgagtgagaacatgcagtgtttggttttctgtccttgtgatagtttgctcagaattgatggttttcagcttcatccatgtccctacaaaggacatgaactcatccttttttatggctgcatagtattccatggtgtatatgtgccacattttcttaatccaggctatcattgatggacatttgggttggttccaagtctttgctattgtgaatagtgctgcaataaacatacgtgtgcatgtgtctttagagtagcatgatttataatcctttatgtatacactcagtaatgggatcactgggtcaaatggtatttctagttctagatccttgaggaatcgccacactgtcttccacaatgattgaactaatttacactcccatcaacagtgtaagtgttcctatttctccacatcctctccagcacctgttgtttcctgactttttaatgatcaccattctaactggtatgaggaggtatctcattgtggttttgatttgcatttctctgatgggcagtgatgataagcattttttcatgtgtcttttggctgcataaatgttttcttttgagaagttctgttcatatccttcacctactttttgatggggttgtttgattttttcttgtaaatttgtttaagttctttgtggattatgaatcttagccctttgtcagataagtagattgcaaaaattttctcccattctgtaggttgcctgttcactctgatggtagtttcttttgctgtgcagaagctctttagtttaattagatccgatttgtctattttggcttttgttgccattgcttttggtgttttagtcatgaagtccttgcccacgcctatggcctgagtggtatcgacactgggcaatttcttagtttcttgtctcttccatatttatgcattgtatttatgtatatatttttgcttagtttatctaaaacaatagggtcctaatgcttatttttgtgaaactctttctttggttcaagaataattcaactagttacattttctttaaaggaatccacctattcagattatctacctcttctggggtcagttttagcaacatgtaatttcccaaaataattatatctcttcatctagtttattctaatttctttgtacagagttaaacaaagtaaatctaaaatgctttcagattcttttcaatgtatagttattctatattttaaaatttctgattagtgttttcttctgaaaaataagttagcttctctttggtggcacacttcactgtaaccacttctgtccccgacctttccgatgtcactgccttgttattagtagtgtaaggattaatacactaacgattctttgtgattgactataccctatccacacctttgtatacagtgtcattattaaacctttttgagttatccaaaattgaatataaaatcactttctgacaaaaattcactactctccattgcaacttttattagagatatgattctactgacactaccatgttaaaaatcatcctttctctaactataatttcacaaattgttagtcctcattctatacttaaaagcattcaaatctctttgcttgtcctttcattgtggatcttttctatagagatcaaactgataatgataaattctatgttcttttttttttctttctcttagaaaatactattccagacttaatattgtctggatctttagagatggtttggagggcctatacttctgctgcagcaattattttatatacaatgtgagaattatttttgtttaatttgcacatacatagtttgtctttgcccttgcatatagcttacataggtgcttctcaaaaccctttctgagatataaataacgggcaagggtgaggtttcattcacagccacttggtcaagttccaatgtcaaataggcattaatccaatgaaggctgtgcaacacatcctttgcttgccacattgcaggcaacaagaaggagagaagagctgtggcccttcagggagcccagacctaggagctccccaagtcagggctgtgacaacttctttggggctctgcagtttctggcattgggagcttctgcagcctttacttttgtgcttgaccctattgctggataaaatataaaatattactaccctcaaaattcaattctagacatttattataacagacaacatggacaatattaaaattaattttacttcttgtagaggtaggatctcactgtgtcacacaggctggtctctgactcttagcttcaagggatcctcccagctcaacctcccaaagcattgggattacaggcataagccaccatgtctggctgataaacagtgttttaactgagacatacctgttataaaattatcactttatccataatgttttccttttctttaaatgtatttacttattagttacttatggcatgctatcataatcaatctgagtgaagccttatattcatctcattttaaaataattatcaccattaatattttgtttattccagtattataatcactttccactatccttcattcatttttgctaagttatgtccacttaatttcttttatatgtttatgtgtatataaaaatgtacatagatgaacttgtgtataatctcatttttataatttttatttaaattatgttttgaggtctatacctattgaaaaattttactatattttttattttcttagtaaaatttatgcttaatgatatatttctgtattctcccatttttccactgctacaaatagatatgcaagaacaccctttaaaatatgtatttttgaactcatataggagagttaatttggacgatataccaaggaataatacattcattgttatatgtatttctagattgttctcaaaaatggctatctacctctttatctattcaacttttcttatgacaaacatgaattatttgcaagcttgaatattaatatcatgtttgtgatattaatactccacatattgtgtggaattgcagttcgttttcattgctgtacagtattttgttaatagaacacatcacaagttaattattcattatagttattgaaaaggattctgctggtctttatgttttgagtattataatagtggttctgtgaatgtgatcagatttcagatcagatacataaccatatgtgtaattgctagctcataacacatgcatatgaaggaccagagagttccagttgctccaaatcattctccaaaaaaataaaattttgttccattttattcattctagtggaggtagtgaagctttattgtgcttttattttgtataatttaattgcatatttaattacattgaacacattttatacaattttttatttggaaattttattttgaaacttgtaatcatccattgtccattaagctatctttcatttctgttgatttgttggaatgtttacatgttctgcaagtatgcccatcaaacatatattctcccacactataactctgtaggctactctttttacctgcttactgttgtcttttgacgaactgaagttcctacttttaatatggactgttgtatcatttttcctagcacaatttatgtcctttttaaaaagaaaattcttgcttactacaagtacataaagatgttctcctacatcttcctttaaagtagaagtattttatatttacacatgaaatccatatggaattgatttttgtgtgtggttcttatacatattatatcccatataactatccaaatgacccagcactattcatcaaaaagaaactcttcttcacttctacactcttgcctttgtcatatctcaagtgaccatttatgtgtggatgtgtttcacaatcctctattctgttattccaatcacctttggtaataaactcttgtataacttttattagattactttagtaaattctggattttctccaatgctattgtaaaagctatcactttaaaaatataagtatctatttgttcccagtatattaaaatatgactgattttatttttatttaccttgtatctagaagcctccatggattaacctgttaattctaatagtctatttctcagcacttttagaattttgtttatattcatgtcttctgtgaatattagctagagtgtatttagtttttttccaatccttatgtctatttatttatcatcttctcacattggctgggaactgctatgtaatcataaattaaaacagtaaaaattggaatctttgcctttttcctgatttcaagaatttttttcaatattttactatcgagtacaatgttaacagtaaagtttttacagatactcgtgtagattgattttgtagattatctgacttttaatcttgaaaagagtagaagtcacactatttccagctttctgtagcccaggtgaaaaccaatataatgagggtttaaaaagacaaatgtatgtttcttataaaacatctatcattttaatttctcattctgaataatcactgtcaaattattatgaatgaatatattgttcaggcaagaggttataaataaagaagtctagcggtggatctcagcaaaatcacatatattctgtaagcttcatttttaattctatggagtgaaggtataaaaattgctgtatccattataactatttagatgttaaaactaaaagaaagaacttttaaaagttttaaagcatctaacatgttactttttcattactgaaaatatagcaaattaaaattattgctaagaaaattcatatagctcaaaatctattcataatttattcttagctacattaattttatacactattcatataagcttatggaaaaatttctaaagatactaaattaggaaatattatttcaggtttggttagtaaacattaaagggaaagtattttcctcagcttaatgactttaatggaagattgatatttttcagaggaccttataaattttctaaaattatttttaaccttgtgacttcgtaaatattgcatattagaagatattcttgtgttatacacattagctaacaagtatatttgtggcataaatttgttttatatgtaatttgtaatatttgtctcttggatgtgttatatattgacttctatatattaggttggtgcaaacgtaattgcagtttttgctaattacttttaatggtaaaaactacaattacatttccaccaacctagtatgtgtctatatttaaataaatgaaagctagaatctgtaatcaaattttgtacttaaattttgattttgtggagaactctgtatccacataaagacaggcatcttgggatattttaaacttttgggacatgtattaatacttttatgaaaaaatctatcactctatcttagatatatttcccataatagcagaaatgaaattaatgaataatatctgtcatcatttcaagatattctaaaattttaattcatcaagtagacttagttctcttagacacataaatttatttttgactatcaaaatttatgagattcacattaaattattatacttataaatccatgtttgtaaatttgtactcaaactgaaaagtatatttattaaacagcatgaaattattctgaaaccaacttaggaaaactctcaataactctgttctttatttgaatcagaggttctcagggtactttttaagtgcctgaacagatcagagcacttgttaagtcccctggacagattattatcagtgagggagtgttagaactgtatctttaaagggaaaattcttaaaacactgttttatttgaaaatgtttgatgttaagtatttttttcaatatactctttcttgccaacaattatgcctatcgtttctttagatatttttattggattagcttaagggaggcttgtttgaactgcgatttctcagagttaatgtctatttcaccaaatggctgttattttgtgcaccttataagagagtcgcaaatcaatggcatattcactagtaaatatttattaggaaagactgtgtgcttcctgtatattcacttacctctgaaagaaacaagtgttataattagattaatatgactcagaaatcaacagatattattgaggtacctactatgtgacaggcaccaggtttcctaatgcatagtttagtgcctgaaaaatagaagatggcatgggaacaatttacttatgtagtcaaacaaggtacaatccatctaactagtaagtgaagatatttttgattgcatgatataaatttaggaatttagcctcttcctaaatgtatatttcatctgttctgataaatgccaaattactgtagacaacacagccaaaattaaatgttagtaaaaaggttatttttgtaataatcaattaagaagcaatagatgagagatctcttgtgaaataaagtataggtagaggaaggaagaagagaacatcaggaactgcatatgagggatagaagagtggaatagcataatgatggttagaaaaatattgagaaggttcatgtttgatgaatatgaattagtagaagagactgatggtgcctagttaatttcttcattttacaaattttccttgcattggctgtatcatggaatgtgtaagacaactatctctgctatgtcacgtataaatgataattgctcacttaaggtcagataactctatgaagaacattttgaaatggacaaggtatttgttattgggcactctgtagagaaaaaattctcaaagtgtgtgtatatcacattagatccataggatgtttgatagtaaaatgatatttgagaatattggaaactattattcttctttggaaattcaaaatatatattagcagattaaagaagtgaagtccatcattgaactttgtaaaatcactctttcctaaatataatacatttcagcttataaaaatgaacaatgtggctcatgcctgtaatctcagcactttgggaggccgaggtgggcagaacacttgaggtcaggagttcgagaccagcctggtcaacatggtgaaaccctgtctctactgaaaatacaaaaattaaccaggcatggtggtgcatgcctgtagtcccagctacttgggaggctgaggcaggagaatcacttgaacccaggaggtggaggctgcagtgagccaagatcatgccactgcactccagcctgggcaacagagcaagcaaaaaaacaaacaaacgaaaaacaccaatgattatatatcattaaatgatattagtttttcagaatggagagcctaggaaaaactgaaaaaaaaaagaacttctaaggtattttatagctctagaattctaggattctagatataaattattacttgtatacaaatacaaatatattcaatattaagctgcttttcatataaaaatgaatgctggaatatcacataaaattaatactactatatttaactattagatgtggagcaaataatacatgttattatagtaaaaattgtctaacctacaacaaaaagaactgtattagggtaaattttcttaaatttacatgaaaatttttgatacattatggtttatgttaacttgaaattattttcatattaattttgagaagctcttttcattttcatcagaattactggctggaaattttattatggttgcatgtaatctatacatcagtgagatgattcctttccatctactttgcattaattttttggaatttgtataactggttttcgtttcttctctattggacctttaaatggctcctaaaaatgtccacattctaatctctagaacctatgaatatgttatttggtaaatgggacttgaggttgctcatcagctgaccttaaaatagggaggttatcctggattatctggtaggcctgatgtaatcataaaagtctttaaagtgaaaaaagaatgtgaaagaaaagtcagagaaagagacgtgataaggaaacaggatcacagtgatgctatgttgttgactttgaagatggaggaaggggctcaagagccaaggaatatgcacagcctctaataaatagaaaaagcaaaagcacaaattatttactagcctccaaaaaggggagacagccttgtcaaccccttgatccttagcccagcaagattggtgatggatttatgatgtagctcaaagataatacattatgttgttttaagccaatacatttttggtaatttgtgagagaagcaataggaaacaaatactgtatgtaaagctagagatcagagtattagaggacaatattccaaactcagaagtacagcaagacaacattttaaatttttaaattcttcaaagccagaaattttaattctttggtctttactagtaggttgttagattgccttcatatttaaaataagtatatttgcataaataaatttatccacaaatagattcacactgaagttgatcaaataattattctcatggtaatttaatctattaaacaggacactcaaatattttctattaaaatgggtatttttaaaattacaaatgattatttttgttttttgattgtaaataatgataggaagaggaaaataattgggcttttttcttttttgccatgtctatctagttttcaatgttttctaactgttttattgatgttctgctttcacttgtgtgaaaaatccattcagaatatctagaattttgagaagaatattggatctgataattctttacttttaacatatttttgaatcatattcgtgtatctcaatgaattgtatttaagtattactaagtaaaatgggaattcaatactttcttgtcaccttgtggaaaataaaaagcaaattgaaattttagtgcctggtaacacattaggtatctatacctcaaagtcagtaacagaaattaaagtagagcatttcatcctggactgtgtaacttagaaccataaatcattttcttgacataaaaagtttaggaaaagaagatttaaaaatgcaatgatgttggacaacattaatggtgacgcactgtcagcttgggatgcctatgccctcaccacatgacacctttactttatactgtctagaactgaagtagaaattgttctgatttgtgagaatatatttaatacaatttgcttttaacttatattttgcttcctggtacctggtaaaaagttcaggagcaatattgtgactgcattttctgcattttagtataaattaaaagggaaaaatttagtaattgctagtataataataagtcactttcacttgtggttgaagccagtgaaatgtgaagcaagtagacctggtctttgtaaaaaaatattattagagtggtaagaataatttatctttcctctaggttagaaaaaatgaggatagcttttcatatgcctgaatatttatttttgtaaaattttatggcattgagaaagtcattttttcaagattgtcaataataaaacaaaaaagctggatttcagggaaatattagtacaacattgtcattaattcacaaaatgagttataatagtaatgttattattattttgactttttcttatggaatcaaatattgactcaaaacctaataagattacactaacattttctttcttccacaaataaaaaatataattaaatgaaacaagtacaagtgtacattttatcaaataagtctaaataaaattttttattcttagtactctgggactcagtctatatgagataacctataagggaaagtcagtttataaaatatttttcttttatcagaaagagtagaatataaaaagcactaaatctaccataatgcaataacatatgaagttgcatgaaatgcagagtcacattattaatgcaaaacaacatttttcactcagtatgtactcttacaagaagcaaaaagtaaatataatgacacatttacacaactgagaaaatattaacaaattatctggatactattatttcctaatcccattgcctagtccccacctacttaagcaaatgctgaaaactctaactcatctccgtttgaatattgaactaataaagggcaaagagccaaagagaatcttgccacaacaaatatggattataacaaagtatacaatgcaatgcttacctggaatttgatagctgcttaatgaagtgcacatagaagtaatatttccataaatatttctgatgtgtggttagaagaattttgcttttgataaaattctgaacatataaatgtaaaacaacttttaaaaggtgtttcatgtgaatatcaactttgtatttgacagcaacaggaagaactaaaatacagacttgaaaatggttgctctttatcaatgctaaactcttttcctgtataatcagtcaatagtttcaaggcttccaaagagagataattctcagctcacaaatgaatgtggaagttccattaaccattttcagtgttcaggaatggagtaaggaaaatgaaattacaaggggaaatgaccatgtgaatatagcacaattaatgactatgccattaatctgagctagtattttatccttctttaatttcattaaaggtgatagaatatctagttaagtagatagttgccatttagcttatatatcatggatcgtttcaattgtttgtcatgtacctcaattatttttttaaaaatattttaatctaaactccatcaccatgttaatttaatgtggtaagctttaagaaatatatatttttgaagataattttatattgagataaataatgatctatacttattttgttgctgaattacaacataaggtagattcaaagtcttattgatatttaatctatgtatcaattatattaatgataagctttaaaaaagctttctgtcataaatatacttgcaaaaaaaaatctcatcctttaaagtataaggaaatgggctagttttccatctttgttgtctgtgtatacgtgaggatttagtcccaatgaaactccatattcccaagcatcgggatgtgaagattctatgatctatacatgtaataccatccccaaaacattaaaattttccattaaaaaaatctgaatacaggtatattacctcagaaaattcaaagccagaaattaactacgagcttaaactgatgaaaaagagatgttctgagggattaactgtcttacataagatacagatatgtcctacttatttataaagctaatcaaattattccctttttatcttttaaaataagttataaaaaatcctcgtagcattttagattgttgtatacacatgatacacatggaacttgtggttattaatttgcaaaagaaaaaattgattttcaatttcaatatttaattcattttattcgtgagagctttacatattgatatatttattatgatatgtacaattagagaatagtcgctaactcagaaataacttttatattaggaagactctaaatactaaatatatgaaatttaaagtattttttttccattagctccagtttttatgtgattacccccatctttggttgaataacctctaatgactttttttctgtgtgattatttatacttctaggaaaattgtttttatttaaacttgtgttcctttaaaatctgtcatgtatttttcttactatttctactgtgttttctctgaattatacattgaaaggtaacactaataacaaatacaaactcatgtctatttccaagtaccctctaacatctaattagtatataatttgattctaagtaacactaagcagtggtctatagaaataaaataacaatccagacctccagacattataatttatctcctgcattatcattacagtcttctcactgttttccctgtgctacaatgccttgctatggattattctctgaatatgtgatgcccggttggcagttcttttctctcaccacttaaaatgttctaccacttttatggcttccatgatttcagatgagaaatgtactgttatttgaattggtgttcctctctaaataaggcaacattgctctttggtcatttaaaaaacttttttgtctttcatttttaagtttcatcaggatatgtctttatgtgtatttcctcaggtttaccctatttgagattcactaagctttttgaatctgtaagtttatgtctttttccaatttgggaagggttcaattattcctttgaagatttgttcagccctactcatttatttctgtcttctaagatttctataatagaatgttcagccttatgttattatctcacaagtctctgaggctttgttcattgcttcaatcaattttctctctgttgttcagactgaataaaatctacttttctgtcctcaatttcctgatgctatcttttatcatatccactgttgaattaggcccatccagcaagtttatttttctattcactaatgtatttttcagttctacaatttccattaggtttcttttttctttctttttttttttttttttggctgagtttttgcctatttttcatttgcttcaagatattttattttattatactttaagttctagggtacatatgcacaatgtgcaggtttgttacatatgtaaacatgtgccatgttggtgtgctgcacccattaacccatcatttacattaggtgtatctcctaatgctatccctcccccctcctcccaccccacgacaggccccagtgtgtgatatttcccttcctgtgtccaagtgttctcattgttcaattcccacctatgagtgagaacatgtttggtttttttggtgtttggttttttgtccttgagatagtttgctgagaatgatggtttccagcttcatccatgtccctacaaaggacatgaactcatcattttttatggctgcatagtattccatggtgtatatgtgccacattttcttaatccagtctatcattgatggacatttgggtacgttccaaatctttgctattgtgaatagtgccgcaatgaacatacgtgtgcatgtgtctttatagcagcatgatttataatcctttgggtatatacccagtaatgggatggctgggtcaaatagtatttctagttttagatccttgaggaatcaccacactgacttccacaatggttgaactagtttacactcccaccaacagtgtaaaagtgttcctatttctccacatcctctccagcacctattgtttcctgactttttaatgatcgccattttaactggtgtgagatggtatctcattgtggttttgatttgcatttctctgatggccagtgatgatgagcattttttcacgtgtcttttggcggcataaatgtcttcttttgagaaatgtctgttcatatcctttgcccactttttgatggggttgtttgattttttcttgtaaatttttttgagttctttgtggattctggatattagccctttgtcagatgagtagattgcaaaaattttctcccattctgtaggttgcctgttcactctgatggtagtttcttttgctgtacagaagctctttagtttaattagatcccatttgtcaattttggcttttgttgatcaagtgggctttatccctgggatgcaaggctggttcaacatatgcaaatcaataaacgtaatccagcgtataaacagaaccaaagacaaaaaccacatgattatctcaatagatgcagaaaaggcctttgacaaaattcaacaacccttcatgctaaaaactctcaatcaattaggtattgatgggctgtatctcaaaatagtaagagctatctatgacaaacccacagccaatatcatactgaatgggcaaaaactggaagcattccctttgaaaactggcacaagacaggggtgccctctctcactactcctattcaacatggtgttggaagttctggcctgggcaatcaggcaggagaaggaaataaagggtattcaattaggaaaagaggaagtcaaattgtccctgtttgcagatgacatgattgtataactagaaaaccccatcgtctcagcccaaaatctccttaagctgataggcaacttcagcagtctcaggatacaaaatcaatgtgcaaaaattacaagcattcttatacaccaataacacacaaacagagagccaaatcctgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcgtggataggaagaatcaatatcatgaaaatggccatactgcccaaggtaattcatagattcaatgccatccccatcaagctacaaatgactttcttcacagaattggaaaaaactactttaaagttcatatggaaccaaaaagcctgcattgccaagacaatcctaagccaaaagaacaaagctggaggcatcacactacctgacttcaaactatactacaaggctacagtaaccaaaacagcatggtactggtaccaaaacagagatatagaccaatggaacagaacagagccctcagaaataataccacacatctacaaccatctgatctttgacaaaactgacaaaaacaagaaatggggaaaggattccctatttaataaatggtgctggtaaaactggctagccgtatgtagaaagctgaaactggatcccttccttacaccttatacaaaaattaactcaagatggtttaaagacttaagcataagacctaaaaccataaaaaccctagaagaaaacctagcaatatcattcaggacatagacatgggcaaggacttcatgtctaaaacaccaaaagcaatggcaacaaaagcttcaagataatttataattgttgaagcaacaagcaattacaaatgaacagaaccacagggatgctttaaaaatcttgatagacaatctcaacatctgatagttttaacattagttgattgtcttttctcattcaagttatgtttttttctgattcttggtatttaatatatatagatatagatttctataatatatacctatatatagctagatacctctctatatataaacatattatatacaaaatatacaaagataaaacaagtatatacatatacaaaaataaaatattttaaattgtattttagacatttggggtattaagaaatttttgatcctatttaaatcttttattttaacagttagccaccctatataggcttagcatgtaaatctgtttttatgaactgtagtttcagaggtcttgcaataattttctggtctgcttcattcttatgaagctattggggctccagttcatttcaacaagtgctatctgggttgtccagtgctaatgggtgagaagttcagaaaaaaatagatgtaggtcacttgctctcatcattagagagctagaaaacaccagttcttttgtgacataggtgctaacatgtcaggcttgccattaccactggttgtgggtatggttgagtctttttctaaaatgacttatgctggtgcagttgtaaatctggctcatgattgccccaggtgtgggcaggtccctgctgctgctgctgcagatctgttactgctgccctaggtgggcattgggtgatagatcttcccatatagtcactgctggcctgcctctttggtcatagacaacagaattttcttgtttcatttttgtttttctatgcttgtttgttgttcaggtttgcagattttagcacccagcttaatatagcgtacaaaaaacaaaaacacaacccaaggaactcatcacacggtcatcccttaagtccaaagattcctagataatctatcttcttccttttagctttcagagtcctttcataattatttgttgaattaccatactcctggtctaattccttaccacatatttcttaggttactgactgcctgctctggcctctacaaattccattccagtgctttttcctctccttccaatgcatcttgcaatgtaccttatatttctaccatcagtaacttctcttcaaataaatataaagaatgtaactgtaatactcattgtcttcatagaaatactttttgtcctttccttttcatgacagcagctcagctcatgccttccacatataccatataattttctgttttgcctgttattatttttttccctacaagttcaaattttctttactacagttgttaatagcatctctgaaatggtatcagctatatatcttctatgaaattttatttcaaatctatgtaacattttgtattcttagtgagaatttaattatgcatgttttacttatttgtccttaaatttactacattgccagtcattgaaataccttgtcaaaagtattctgaattgcttaaatcccctgtgccttctgtatctaatatattgctggcaaaagaaaatgtacttaagaaatttaatttaatcaccatgctctattgaaatctatatactcgttaatgatttttttgtttcataaaatttcagaaaagtgacctttcgctttagaaatgtgttaaaaatgattcattttcttttttttttctttttttttttttttttttttttttgagccagagtctcactccaccgcccaggctggagtgcagttgtgcgatctcagctcactggaacctctgcctcccgggttcaagcgattctcctgcctcagcctcccaagtagctgggaccacaggcacgcgccaccacgcctggctaatttttgtattcttggtagagacagggtttcaccatgttggacaggctggcctggaactcctgaccttgtgatccacctgcctcgaactcctgaccttgtgatctgcctgcctcggcctcccaaagtgctgggattacaggtgtgagccaccactcccggccttttgttttcaattaaatagtaaaataatcccaaataatgtgaaattaaatgaaggttctttataaaatcatatattcttggttttattttagattaatattcattaatgaaaatggcaactgtgacagatatacactggatttacatttggtcttgtattttaagcaatataaaaaaagctttcactgtccatgttaaattgccaacccttgagataagttcaatgatgaaataagattgtttatcattggtatgtacttgggcatcatgacatagagaaaacgtagttctgtatttatttgtgtttgtgtatatgtgcatgtgtacacacttataaatacatatatatgcacatatgcaacacatgtacatatattcaccacatatacacatgtgtatattatatatatgtgaatatatacacacacacaaataccatttaagtgaattttatctaagtaattgaagtcatattccaagtgctttctctgtgccctacatatacattttggaggaaattaggcccctgtctcctgtgcttttacacagttcaaaacagcatttaaataatcatttggcagaggagctcctgccaactcattcttattgttttttagaaaaaggaaatcattaagcactagccaaatctaagtactgggaaaataatgaaaaaaataataatctagaactttacataatcacctatttggaaaaatcgcaacacttctactttaatattacaatgtatatttactagtttataaacataaatgcacactacaaaggcatactcagttaaggtttatctaaatttgaattcaaactactgaaaataattcttttatatgtcttgtttttccactgacttattttaagatatagcactatcatttcatttccagtctgcagctagaagaaaatgaaattttcccagtgtacctcttaagataaatccttctgttaacttttcacaggatttcctaatagagttaacgtctgtgaaattcaggcctgcactggaatccaaaattcatctcaaggagaattttaaaaaggattaataaatacatcagaatgaacttatttatcatgaattatatcatatttcactataaaatggtattgtaatgtgtaggaccataatttgagtgtctgtgtaggttttggttatagccagccttctgtcctcaggaggggagaacacagcacatttactaatttactccttgcttattccagaatgggtccatttttattagatctctagctctcatcagaggcatttattgcctaaatatgcaatttaaaaaatttaaacctcaagcacatttttcaaaggctacgtttattagaaaactacaagtgaattaaaatctttcattgattaaaaaaaaagaattagaattttgtatttgcttcttaatctctgaacatattcctgtgtccataaaccaacatttctcaaagtgtgttggtagtaactaataccaccaactctgaaaaattatggaatggctgttaagtactgggttacatcaagttcagttatatcaagttaactgaaatttttgaaggctctaacgtgtttatgagatttgtgaatggctaatagtgcactgtatttgccaagtgcatttgaccagagaaatattcacttctttctttccacattccctcccctagtatctcattgaaagagtattctggaaaaccaattatagaaatgctgccctagaaaaataacttcccttaaataggtgaagtttattttttgttttgtctaatgattcactttggggacgtaggaaaccctccaataacacacacacggacacatttaccctccctcactattccccagtgttcattattccgtctccttttcagactttatatctgggtgctgttagttttaccctttattgacagtaagcaaaaaatctcctcatttaaaccatatccccctgatctggaaatgcatagcagtctatttcttttacaaatattagtacatatttttaaaaaacagcattgtaaagcttcttctaggtagtgaactcactagttgtatataatgtttgatattaatattgaaaaggcatgtggactctggtaagaagaaagctaacttaaggtcctgactccatctctctttgtaaccttgaacaaatataaaatatttaacctataaaaacctcattttctcatttttacaaaagacaccagaataataactatctcatgaggattaagaagatataaaccctctttgtataacacagtacagaccacagataaagcatttggtgaatgacagttattagcactgtagctatccatattgctattcttttaggtagtacagatagaactttttcagatatcacctagtagcaaagccttccctcaaagcccccaaaactttgatttggaatcatttgcaactacacagtattctataaaagtaatttcatgctcagcatatggcactgcaatatttctattttcttcctccaagactgtgaccatcctaggtcatccctttttgtttattcagtatctttcatcacacttgacctgcaataagtgcttaaaactgcatgaaaaagataaataatcatggacataaataatgaaaatctagtgaaatgaaaatctagtgaaatgaaaatttatcattctaaccaattgccaatctagtgttttatccataaccagtatcattttttgtttctcaaccatgtaagaaataggattatataaaatgtaaacatttctacaaaatttggttaaataaaaagatatgaaatattaaagtgttttttacaagtaaaagttttgtatatggttgactcttacatgtcaacatgatataattgacatctaatatgttacttatattgtgaattactttgtatttcaattataaactactcagaatactttgatttcctggctaatattttctctgctttaatctgtcataatttctttatgataattccaagagagcttccttttctaatatttatgtgattttggactgtgtgataaagagtttaaaataatcaaaacatttttgtgtccttctttatgctttctgtaatataaaatataaaaatgagaaaagaaatatatgatagaagccatattgtttaacagctaaaaagagaagttagcattttatttcatttcatttcactatcgataaagcctatctaatgaaaaccgtcagaagcaatctacagtccaaaatattaggtttattttactcagcataatgtcatccaggttcctccatgttatggcaaatgacataatctcttccttttttaagactaaataaccttccattttgtctatataccttagtctctttatccattaatccattgatggacacctaggttataatcagtattttggctattgtgaataatgctgcaaggaacatgagagtcatgttgtatatcttaaatataggcaacaaaatttatttaaaaacaaaaaattaagtttatttacttgttgcaacaagggagaacattgtctatgggagctataggacatctgatgtagtaaaaaagggtttttgtataggttggtctggcagtaaatatttctgaggagtccagatgttttgcagaaataaggtctggatttgttgcttttgtgaggcaatgaaaggttcatactgagtaccttagtattcttgatagagatatatcaagcaaggtcagggacattgttgacaagaaagcagtagttacttgaaaaaagaggaaagcagtagttacttgaaaaaagaggataattttagtcctcgctacttgggaggctaagacaggaggatcatttgagcctaggggtttgaggctgcagtgagctatgattgtgccactgcactccagggttggtgacagagctagaccctgtctgtgaaaaagaaaaaaatttaaaaaatttaaagatttttaaaaagtggataattatgacactttaatgttacaacatcaacttgagagaaacattgtttcttgttaactttgcagaaagatttgagagtgtttgttatcacagcctgattaatggcaaggccatatttttgtataatttttattagttcaatattacccatttgcttaatttcctcaatcagtggacctcaaatacactgacaaattcatttttaaattctcagggctttatttgagatacagtagaagctcaaggaataaatgaagatcataggcaatgtatattttaccactaaatcataaccagaagaaaatgatagctattgaattatttagctaaagggaataagcctaatccacaattttctattttgtatgtgaaattttatggacttattttttttagctagatctttcttataatgacatgaaaacttagttaaataaaaccagtttaaagcatttgcttataaactggtactattatttccttttattcttagcatccatccttccttagattataaaatttaactgttaaaactctctcaagtgtgttagataatgattcactctttaacctttcgtcttataggatcaactttcagacacatgctcgaacataatcgatttatagtagtgaatctagtagagaatcaacagggaaatttagcactggatttattttctgaagttgcttgctctgagaaataggtgagagacctttgtaaattaagagatacaataatacactctttttaactatttgttttgacattcttgaatttttctcccactaattggaacaattgaatttcttgatcaagaatagatatgaaaatcaagaaagaaaaacttgtgaagtttaacagaaatgagttcagagaccatctcttctagtaagcaagaaaacactacaaatatatgcaaagataaataccagaaacctattaaaactgttgtcttttattgtattcattaataacacaatagttaattgtggtttttaaggaggttacgggtgtctaaaattttgagagactattaaagcaattattaaatttaaaaggtgattattttatctaatgttaattattagaaatattttggtatgtttgttatattcttaacatataaagtgagatttactggaatctttatattgttgactgaggcattctattagctatgtgtaatgttggaaaacaaaaattattttaagcgtcatttgctaaataaattggaatacggtgcacataaattgtttaaatttagacttaagaaaatagcagatcatagctgaaacttcaataccaaaaatactttgctaatacaccccctcataaaaccaaggacaagaattcagctacaactaaagactctgcataaagtcttggccctctgtaaacatccagaaacaaagtcaactgactatacacaaataacaccacatttaaaggcacaccagcccacacagatgagaaagacccatcacaagatctctgggaacacaaagagagtgtctgctttccttcaaataaccacattagtcccccagcaaggttcttaaacaggctgaaatagctaaaatgacagacacagaattcaaaatatggacaaggatgagtatcatcgagattcaggagaaagtcaaaacacaatccaagaaatgtaaggattacaatgaaacagtacaggaattgaaagaaaaaacagtcattataagaaagaaccaaactgatctgatagagcttaaaacacacttcaagaattacagaacgcaaccacaagtaataacagagtattaacagcagaaaagaccaagctaaggaaataatctcagatctaaaagactttttatccaaactaactcagacaaaaataaagaaagaataataaaaaataaacaaaacctccgagaaatgtgaggttaggcaaagagaccaaatctatgactcattgacatccctgaaagggagggagagaatacaacaaacttggaaaacgtatttgaggatatcatctatgaaaatttccccaaccttactagagaggccaacattcaaattcagaaaatgcagcatacccctgtgagatactatacaagacaaccatccctaaaacacatcatcatgaggttctctaaggttgacatgaaagaaaaaatattcacgtcagctagagagaatggacaggtcacctgcaaagagaagcccaacagcagaactttcaacagaaactgtacaacccagaagagattggagcctatattcagcattcttaaagaaaagaaactccaaccaagaattttgtatccagccaaaataagcattgtaagtgaaaagtagaaataagatacttttcagacaagcaaaggctaagataatttattaccaccacacctgccttataagaggtactcaagggagtgctaaatatgaaaataaaagaccattacccactaccacaaaaacataccttaagtatataaaccatggacactataaagcaaccatgcaatcaaggctccataagaagcacctaacaacatgatgacaggatcgaatctgcacatatcaatattgaccttgaatgtaagtggcctaaatgccccagttaagaggcatacagtgagaatttggataaagaagtgagaccctactgtatgctctcttcaaaagcccatcttactaacaatgacacccataggctcaaagtaaagggatggagaaaaactaccacggaaatggaaaacagaaaaaagtaggggttgctattctaatttcagacaaagcagacattaagacaacaataaaaatgacaaaggcattacattttggtaaagggttcaattcaacaagaagtatatatgtatcataagtatgtatcatacaactatctatgtatatatgtatatatatagttttatatatatagatatataacatacaactatcataagtatatatgtaattaataaagaagaacccagattcataaagcaagttcttaggtacctatgaagagacttagataaccacacaataatagtaggagacttcaagatcctactgacagtattaggcaaatcatcgaggcagaaaacttacaaagatattctggacatgaactccacacttgaccaaatgggcctaatagatatctacagaactgtgtacccccaaaccacagaatatacattttttcatctgcacatgacacatactctaaaatcaaccacacaggctgggtgcagtggctcatgcctgtaatcccagctctttgggaggctgaggcaggtggatcacaaggtcaggagttcgagaccagcttggacaacatggtgaaaccccgtctctactgaaaatacaaaaattagctggacgtagtggcacatgactgtaatcccagctactcaggaggctgaggaaggagaatcgcttgaacttgggaagtagaggttgcagtgagccgagatcgcgccattgcactccagccagggtgacagagcaagactgtcttaaaataaaatgaaataaaataaattaaactacacaatagacattaaaaatcctcatcaaattcaaaataatgaatcgtaccaaacacactctcagacaacagtgcaataaaaatagacgtaaatactaagaaaattgctcaaaactatacaattacgtggaaattaacctgctcctgaatgacttttgggtaaacaatgaaattaaggcacaaattaagacattatttgacactaataagaatgaagttacaacttaacataatctctggcagacagctaaagcagtgctaagaggtaagtttatagtgctaaacctccacatcaaaaaattagaaagacctcaaataaatagcataacagcacacctagaagaactagagaaacaagagcaaaccaaccccaaagctaggagaagacaagaaatactaaaaatcagagctgaattgatggaaactgagatgtgaaaaaccatataaaagatcaatgaagtcagcagtttgtgttttgaaataatgaatatgattgatagaccactaagtagtcaaataaagaaaaaagacagaagttccaaataaacacaatgagaaatgacaaagaggacattgccactaacctcacagaaaaacaaaaatgccctcagagactgtgaacccctctatgcacacaaactagaaaatatagatgaaattcctggaaacatacaacctcccaagattgaaccaagaagaaacggaatccctcaatataccaataacaagtcctgaaattgaatcagtaataaaaatgttaccaaccagaaaaagcctaggaccagatggattcacagccaaattttatgagatgtatgaagaagagctggtaccattcctactgaaaatattcaaaaaaaaaaaaaaaaaaaaaaaagaagaaggaagaaggacttctctctagttcattctatgaggccagcatcaacctgaaaccaaaactcaaactcaccagaggcacaataaaaaaagaaaacttagatcaatatccttggtcatggatgcaaaaatcctaaataaaacactaacaatttgaatccagcagctcatgaaaaagctgaaacaccatgaccaagtaggctttatcactgggatgcagggacatttcaacataggcaaatcaataagtgtgatttatcacataagcagaagtaaaaagagaaaccacatgatcatctctatagacacagaaaaaacttgatataattcaacatcctttcatgtttacaaccttcaacaaactagttattgaaagaacatacctcaatataataagaaccatttatgacaaacccatagccaacatcatactgaacagacaaaacttggaagcattctccttgttaaccagaacaagacaaggaagtcctctcttaccactcccattcagcataggactggaagtccttagccaggacaataactcaagagaaagaataaaaggcatccaaataggaagagacaaagtcaaactatctgtttgcagaagatatgattatatacccagaaaatccaatagtttctgccccaaaatgcctagatttgttaaacagcttccccagtttcaggatacacaatcaatgtacaaaaattattattacttctatacataaacaatgtccaagctgagagccaagtcaaaaacaaaatcctattcacaatatccacaaaaataagaaatcagaaataacacaaaaaaattaaaaaaaaaatttgatgctcatggataggaaaaatcaatatttttaaaatggccatactgtccaaagcaatttatagattcaatgctatttctatcaaactaccaataacattcttcacagaattagcaaaaagaaacctattttaaaatttatgtggaaccaaaaaaaagagcccagatagccaatgcaattctcagcaaaaagaacaaagctggagggatcacattacctgacttcaaactatactacaatgctacagtaaccaaaacagcatgacactgtcaaaaaaaaaacagacacataggccaatggcacagaatagagagcccataaataaagccacacacaacaatctgatctttgataaagttgacaaaaacaagcaatgtggaaaggaccctttattcaataaatggtgcagggataactggttagtcatatgcagaagattgaaactggaccccttccttaaaacatatacatgtacatatacatatacatatacatgtatatatacacatacacatacatatctcacagcaatcagaatggctattactaaagtcaaaaaataacatatgttggtgaggttgtggagaaaagggaatgcttatacgctgctgatgggaatgtacattagtgtagcaattgtggaaagcagtttggtgatttctcaaagaacttaaaacagtagtaccattcaacccagcagtaccataattgggtatatactcaaaggattataaattgttctaaggtaaagacacatgcacatacctgttcactgaagcactattcacaatagcaaagacacggaatcgacctaaagacccatcagtagtagactgagtaaagaggatgtggtacatttaaaccatggaatactaaacagccatgaaaaagaatcagatcacatcctttgcagcaatgtatggaactggaggccattattctaagctagctaacacaagaagaaataaataaatacaacatgttctgccttataagttggagctaaacattgagaacatgtggacacaaataagaaaaaaacagacactggggcctacttcagggttaagagtgacaggagggagattatcaaaaaaactacctgttgggtactacacttattacctaggtgacaaaataatctctacacaaaacctctgtgacacacaatttatgtatataacttacacacacatactcctgaacctaaaataaaattttaaaaaagaaaataccacatgatgctgaagacaaaagtttttacagtagtttataggatgagcatcatcctttcatattttctttcttcatttcagagatttattgaatttatacaaataatatttgatagagccttgaccattagagtactctatatttcaggaaaaaagacttccacaaggtaacttcaccttaatatagaatcatgttattcaagacagatattgtttaagtagcaatgttttagaaataaatcagcactggcaaaagaggcaaagctccattttgaggcagtctagacaaagggtctggtttccatttcaatgaatttaaattgaatgtagaataaaaatggaactagcctatgctgttggcccctgtttaaagcttaactctagagaaaagacgaaaaaggagaaaaaagcagcattctgaaaaattaacatcaaatgttgagaaacccttccggcaataagtcagtagtgataagggagaatttgcagtctaaatcaagaggctctgcataaggggctatgttgggtgcagcttttgagcatttcttttgttcctcccacattaactttggcatattgttgtttgaccctgccagtacataacaaaaaacagttgctgcagctgaggccacccaggttttgttagggtaacaacaagacagcaccaaagcttggccagggcgggaatctggttcaggtagaccagctaaacttgaaagtttctactttcttcttctctccattctctactctcaaagatgtgaattaaaatcaagattataaccttgaactggtatactttttctttcttttttttttttttttgagacagagtctcactgtgtcgcccaggctggagtgcagttgcaagatcccggctcagtgcaacctctgcctcccaggttcaagagattctactgcctcagcctccctagtagctgggactataggcatctgccaccgcactgggctaatttttgtatttttagtagagacagagtttcaccatgttggccaggctggtctcgaactcctgacctcaggtgatctgcccacctcggactccaaagtgctgggattacaagtgtgaaccaccacacctggccataaactggtgtatgttttgaagtttaaggaagtattctgagggatggagttgcaaagttctctgagggatggagctagaagatatggtggtaggaatttgagtacttcagtatctagagtacgctttcctcaggcaaaaccctcaacttttctcaaagatacggtacaaatcagagtctgggtttcagtatcttctcctgataagcatacccagcttcacctttgggaacacttggaagtaagaatagcttatggataaaaaaatattacacacatgttttatatcattgctatggaagtatgacaatgaacaaatatgggtttcataaaagtaaatagaaggagttaagaatttaaaataggaataataagtagtgtgctcaaaaagaagagaagaaattagtaatttgagagaatattagtatatgaagctagatcaaggagccacaataattagtatgaaaaatatcataatgaacattttaaaatagatggggttacttctggtttcacttccaaaatgtaaagctcgaagtctttacttacctactcacaagaatagctggaaaaagtgaaaatcaatgacttatcttgtatcccaaatagctaacatcataaggcagcctgcaaccctgaaatttggagaggcagatgagtccaaagaggcacagccaagacctgcttacctggagcagaaactgctagagccagaagctaatataaatacttaaatgctaactttgatgaatgcaatagactgatgaggactagtgtgagaataaaaaacttctgagctgcaatcttgggggaagcccatacttttctggactgttttctcagaaagccactagttctcacagttaagatctcgaatctctcactgtggctctagcagagagagagagttatcactctgaaatgatcctagatccttctccataacaaaagcctactttccagaggaaaagaattagccagaactttatcctgagaaaatggaattcctctgacttaagtcccctccagagccttcctatccacaatcaggggaaatcacagtcaacaggagtgaagatttcaagtaaattgattagacccctacactaggaaagaaaataggagactctgggagggaaaaaaaaagttataccatttgaggaacacttgtaaagctcacagcccaaggtataggtgcactaaaagactgagtttaatgagaagattatagaatgttccttctctcccatataacataacactataccaagagtactctaatataataatagtagattaaggctgcaagaaatgcaagaccaagaatatatatatatatttaatgtaccttgttctacagcaaagtaaagcaataaaggctctgaggagtaatctggccacattttaagaaaatatttaaatgtgatttctccactaaaattaacccatcctaaagttatttgcaagtggaagaggtggtttatggttagtttaaatcatttctccactaaaagaaattcccagaggcatccagaatctctcttttctcttgtagttatttttattgtctgtctagacttttaaaacaggcttctaggtgtgactaataggccatactgaaatacttcgcataacattacactttcagatattctcttacaccttgccttaaatttagctatactcattttctcttggacaagctttcccaaggtggctgttcaattacagttgaagctaatgagtctaattcagctacctctactcagattaaattgccttgcgattcagtgtcagcacctttttttaaacaatctctttgaatgttctgttaaagtcaagtctgaaaataagatagtttgcaaacaatggaatttcatttccagatgtagagcatctaacttttatttggtaatcaagagaaaggaatgcattagagaaggaaaatcaaccatattcttacttcaacttaaaaaagaagttagcctaaagtggaaaaggacttttcattaaattaaagttcattagaaacaatgatttttattcaagttttaagatgttctaaattcttttaaccccctgtattgcaaaatttttattagacaacaattatttcatgcaaatattaaaatagtatttcaatacatattgtaatatctgttttattcctggtgatatgagcatttttttcaaatgttcttattgtatataaaataacataatgtactttatgtgtacatgagtgctgtttattgcctataaaacattcatcttgaatttccacatctgttatttatttgctgaaaacacaatgtgaatttttaaattgcactcatagtatgcaaataaaatgaaatagcaggcaaaaagtccctggcattcaccataaatatatataaactgatataaacaagccgactaattttgtgacaaaattttctacagtgttgcgtggtatagtgctttaaaatgccacattccattaaatatagaagctttcatgagatggatatggatttagcataggaacactattctatctttaaatgagtaaaattatttattgcttgtgtttatggacaaaagaaaacttgctcaagaagtaagcccatgaaggactcgcagtttacgagactataactttgctacttccatttgtttttacaaggtagtaacatgttagatttgactgtcctgacattatggctagcatttcctggtcattgtttgaaaaaatgtgttgagcatcttttgcacaatagcccataaaaccctcataaccaccctctgagaaggtagtaccattacaacattttatccatgcagaatctgaggctcaaaaaagataagacacctgctaaatacctgggatttgaaatcagtcaggactgggtttagttaatcttcctgttttaaagccgttaaagctttaattgaatcacataacaaacacaatttaaggtggcttgtaaaaaccctggctctgtctttcggactcacaatctaaggtatacgcacaatccacagctgtagttgaaatatttacaaagtgcaaaaaattgtaaggtagctcctgactctgcctcagtttcagtaatagtcttggagaggggcctgtagcaagcgacagtattcacaacttgtctaacaaaggtgactgatcctcaaatccactaatagttaaattacagaagagccattcttcctatgttatgtgaaaatgtcaaaagtataggtttttaaaaaatagagtcacttttttttgaattgataaaagaaattagaattttagaaagcctttcaaatgaattaaaaaaaaattgatgggttgggcttggtttataggctcccagtttgcagcctatatgcaaatatggactcatctattccctctgttctgagatttttctcagtcatctggtttcactgaataacagtgatgcagaacagatgagtctacaaattagggcttagcctaggagggttcttggcttcacccaagaaagaactcaaggatgagccagtggtgttagacagaaatatttttactaaacagtactgctccttgcaaagctatgtaaattgaggggcaagttatttaaaactttctaagaaaggggtggcaattgtaaactgccatgacactggtgggaatgccttatactaatgagcaatgagggaaactagggatcacttttatggccatctgctggttcttgccagtttcttcactttaacctgtctagaccagatcctgttttggtcagcagggttgtgaccagaaaataaatcctttcagtctccgaatctcagcaatactatctttaccctcacctaggattaaaaccagtaactggaattattttttgatcttctatagccaatgccttgtcaggccctgttatcctcatttccattttcactgaatttgctctggtcacatcttcatcaccaccctacctcagtttttcttatgctagtccactcttgctcaggattttcctaaaacattttttttcctgtaaaactgctgcttagaaacttgtgatatgtttctaccccctaacagaagtaaattaaaggccttccatgacctgacccaatctatcttttatctttctggttcccagtgccctaggttaacctccatataagtcagggttctccagagaaacagaatcaacaagatatagatataagtatagatatatagatgtaataaatacatatttattataaagaattggctcatatgattatagagcctgagaaattttaagacctgcagtaggcaagctggagaccaaggaaagccaatggtgtagttccagcatgagtccaaaggtctgagaacaaaaagagctgatggtgtctgttccagtccagaggtcagcagtcttgaaacctaagaaaagctgatttttttttttttagttcagatttgaagggaggaaaagaccaatgttctatctcaaggcagtcaggtaggaggagttctctcttacttagttattttggttgataaaagtcgttaatttattggatgtgatccatccacattggagagggcaatctattttactcagtctacagattcaaatgtaaacttctgctagaaacaccccatatagacacatctagaataatatttggccaaagttgggcacccgtggtccaatcaagttgacacataaaattaagcatcatatatttcttccctaaaagttctaatatattatgaaatttacttacataatgtatgtttggattatccactttaccagaacatgagttccacaaaaacagggcttttggtcttctttgatcattcttttatacccaacatttagaaaagttctccacacaaagtatattgctccacaaattgctgctggataaatattgttatatcaatattttgtattaacattatgacttcttatactgtaaagctacaccttcccaaatgttggttttggacacacgtattgctcttaaatgactgggaagtgtgattatggtggaaacagaagaaagaagacttgctttgttttgtagtctaggagggtttcataaagaagatgagacaagttgtgccctgaaggattagttggaattgtggtgacttcagaagaagatggaatacgttacaggaaaaagaaacgacttaaaaaaatgggaagagggaaaaagtgcaaacatataaaaagaggaagagagttgatcaaattggaaccaattagaatttttataaaaggtttgggaaggaaggaaagcagtaacagttttgtcttaatgatgtttgaggagaaaatgtctgaagttatggttttagagttgaagttgtattttaaagtcataaatgctgtgtccagggtttttacattatcttgtgatgaaagggaagtcatcaaaagtcctcaaagaagataacagcatgacatatgtaaaatgtaagaaaattaatctcaccatgttagatagctcataatgataaagagattatgcaaagaaaataaatagatgactgatattttattcactgtaattttagttcttccactaagaaaaagcaaaatcaattatttttcaaataaaagggcatttgttaccaaagaaatatatttatttttgaggagatcaacatactggagactaacaaagtttgggagtctcgggaagcaccacctcccatatgtcttcatgtcactcttgtttaactgttcagggcccagaacaggatctctagactgaagctgagaataggcactgagaagctctttgttaaatgacatacagatttatactttctgacaactacgatgctatttttttcttagatcattattgaagatccctgcaaataaaatataagtcaaaaagtggaagtaatccatccttaaagtggatggatcagacctgtgaaatcagtttttcttctagaaaataaataatgagcagtgaattagtactggctgtactttaagctgcagcgatgtctgctgttccagtacaaatagtattactttgttattaaaatcaaagccatttccttggttctaaagacaacttctccatcagcacactccattactctgaaaagtactgggtgaacaatgcatttataatcgtttaaaatagcagtgttaagcttgtgtgattgtgtgtatgtgtgcgtgtgctaaacatactacttcaacaaaaaagggattaggattaaaagcagggtgaaatcagagaaaatgggaaggaagagaaaactcaaaagttgtattatgaaaacaaactttgagtgtgattttgtcaaaacaagttgattgacaactctttccattctatccaaatacagaatgagaagacttctctcaaaagaaagtctagaattctatggttgtgaaaagttgtgactgga

SEQ ID NO: 259 - DNA, 32 bp, Homo sapiens
tttacttgagattcacatataaatgacttttg

SEQ ID NO: 260 - DNA, 4532 bp, Homo sapiens
gttttctgagactgcatccactttgatagtttctactgagtccaaattagaacatcccagctggtgggctgtctcccaggaagccctcggagaggagcggtgcatagggggcacctggacacagcccacctcccccgagtagcgtcaggtaggcttgtctatctacatcctttcgccctttctcaggaaactatcagatgatgtgctcccccagatgaagaagtagtgccaggaaaaaggagacacgggatacagggatcctgaagccggcggaggacaagggagctcctgggaggacagctgtgctccggcctagcaatagcgagcagctggtccagactgccgccgtgactcagaagatagacatgcggagggttatgatcacagagcaacgatggtccttgtacatgaagataaaaatgctcaggtgtgcccaggttgaagaagatgaaaggccctgcctcccagagcgcccggggacactggtgatctcttccaggtctgtttccacccactgcagctgtggtgagtctagaggcagaaaattcatagcagcccatgccctttgaccatgtttctgctggtcagcctgcacctcactcacactacgccctgtgacacaaccccagacagactctggagaactcaaggggacgtggaagccaggctctgcccggaagctccactcaggtcatcttcagggagccgtgggagcatcattgccctcccctttcaaagctaggtctgtgcttactgctcagtttttttccaaactaaacaatgtttttgagagattcacagagagataaaagcaattaggaataaatgccagggggtggttaacacaaaggtggggatattggttacctctggagaggaaaggggatggaatggcagagtgctcaagggtctctggaggtgctcctgtctccagtgtagtcacgtgaggttcactttattctttaatctgtacatacactttttttttttttctgagatggagtcccactctgtcgcccaggctggagtgcaatggtgtgatctccgctcactgcaacctccacctcccagattcaagcgattctcctgcctcagcctcctgagtagctgggactacagatgtgtgccaccacgcctggctaatttttgtatttttagtagagacagggtttcaccatgttggccaggctggtctcaaactcctgacctcaagtgatccgcctgcctcggcctcccaaagtgctgggattacaggcgtgagccactgtgcctggcctgtacatacacattctctataaaatattttgaaataagcacttttaattaattaaggattgttctggaaaagaaaaaaactttctactgaaataattggctgagatagaagtaattatgtcttaaatgatctagataattttatgactggctgaagcctcagcatcagaagcaagggctgaacattttggcttcctgccaaccttgactcactgagcaaatgaatttaccttcaacaatatgtacagtccagatgtgcatttgtgcctgtctcattctcaatatgaaatatgttttgagaattgtttggggtaaaaacaacaaatgatctcttttgtccacatacttttcaccgttccttcctcggcagccaagtcgactcagctggctctttgggacctggcacattaaaactaaaatgtgctccagtggacttcactgtgtttttttctttctttaaccagcacaggagctgcagaagggcattttgaagtctggaggtaatgccagttggcctgggcagggaacaatgtgtgattaagcagtgaaggggataagggacaaattccgggagccctgcttatctctgctggaattactgtactgcaggtctcaaatcctgaaggatcctgtatttgttttcacctggaacctggaccacattcaggtggcagattaaaattaagccaagttcattccaggccatcctaatgattttttaattagcatcagtgcacagtgtagtaatttgcagttcatagtccacttgtaagttgaaattagaaactgcaaggacagtaatataagtgggaggagagatttcattaatcccgtcaacaaatatttattgactgcagctgtgctagtgggtaatgataatacagctaagagccaaaacaaagttcctcccctatgggcctttctttccagtgggaagagggtacagggtacagtcaataaatccaaatatatatatttatgtatgcacacagatatatatataaaacaagtggaatgtgctgtgaagaagaagcagggtaaggctctggaaagggccaagggtgtgcgtgagtggggtggttactgtatagagattggccacgccgggtgcagtggctcacgcctgtaatcccagcactttgggaggccgaggtgggcggatcacctgaggtctggagttcgagaccagcctgaccaacatggagaaaccccatctctactaaaaatacaaaattagccaagcgtggtggcgcatgcctgtaattccagctactcgggaggctgaggcaggagaatggcttgaacccgggaggcagaggttgctgtgagctgagatcgtgccattgcactccagcctgggcaataagagtgaaactccctctcaaaaaaaaaaaaaaaaaaaaaaagagagattggccaggaaaggcctctggcaagatgatctctgaaggaagtgagagtaagtggtgcagcttttgggaggaagatagtgctgggcagagggaagagcaaaggctacgtctctgcattccaagattacaaatagagggtaacattcaccctccacccctcaacgcctctttcctgtgaccttcgggagctgcagaacttcagtgtccatcagtcagaggcaatgcccctgacccagacgcctctagttgagagatagacagagctggatttatagcaccacagacctgacctggaatgagacttgcaagtatgtcagggagctgcacgctaacctaggaagaggctggccaggtaccattttctgtatggttatgatgaagcagctggtacaaatgttaggggacagtggcacatggtgggggaaaagcccagcgctcagcttctggtctggcttttctaccttaggaccttttactgtggtctgtgggtcttggggtctgtgggtcttggggtctgtgattggataaatgaaggtaagtagactgggaaggacagaacagggaacacagatctgctttggccgggcatgggtggctcaagcctgtaaccccagcactcataatgacttacaaaagcattcattcataacttacaaaagcattcataatggtggcctttgagagctgggattatggacaacttatatacctttttgctacttttatgtgaatttctacaaattacttttttttctttttgagacagggtctggctctgtcgcccaggctggagtacaggggcatgatctcagttcactgaaccctcctgggttcaagcaatcctcctgccttagcctcccaagtatctgggacgacaggtgtgctccaccacgcctggctaatttttctatttttagtagagatggggtttcgctatgttggccaggctggtcttgaactcccgactgcaagtgatccacctgcctcggcctcccaaagtgctgggataacaggcatgagccactgtacctggcctacaaattactttagcaacagaaaaagaaggtgagcaaagttatgcacaagtgtattaacaaactgctctcctgtacctaaatcagtcattcctttttttgagacagagtttcactcttgttgcccaggctggagtgcaatggcatgatctctgctcaccacaacttccgcctcctgggttcaagtgattctcctgccatgcccggctaattttgtatttttagtagagacggggtttctccatgttggtcaggctggtctcaaactcccaatctcaggtgatgcgcccgcctcagcctcccaaagtgctgggattacaggcgcgagccactgcacccggccactaaatcagtcattctatccagttccttgcatttactcctttcttgtgctaacccacagccagtacttaagagtatttaagtcctctctcctttcatgagtcactcctttttgtcttgtgactatacttggaaaaattttattattcattcatttatttatttatttatttatttatttatttatttatttatttatttttagatggaatcttgctctgttgcccaggctagaatgcagtggcgtgatcttggctcaccaaaaattctgcctcctgggttcaagtgcctccacacccagctaattttgtatttttagtagagacgagatttcaccatgttggccaggctagtcttgaactcctgacattgtgatccacccacctcagcctcccaaagtgctaagattacaggtgtgagccaccatgcccggcctacctggagcattattaaaaccttaaacctttaa

SEQ ID NO: 261 - DNA, 30 bp, Homo sapiens
gcaggcagtttcttcaaaggcaacaggaag

SEQ ID NO: 262 - DNA, 16316 bp, Homo sapiens
gactgaaaaggcagagtgtcatttgaggatgcgagtagtataatcatacttttttgcatggaagaaagcaagtgagtactttaaactgtggaattgggatagcaggggtggggcctatgatatgaatattcatacttttcatttacatttttatttttattgcagtaaaatctagaaaatgttgagaggatttttaaaaatttaaattacattcaattcccatacatctttctctagaaaggttctaaaggaaaagaaaaaaatagctacatagagaagtaaggtatgatgaactatcttgaagactgagggttttctactgttaataagtaagttttcaaattatagattgaatatctactttgagccaggctgaggactagggagacaattgtgagaaaaacattacacaatttctacccctttggatcttactgtctataataaagggaaatagacaaataatagtcataaagcatgatagacgctttgatgggggaatttcaggatataaggggcaaatttctgccctctgtgggggtaattaccaagtctaggaaaactgaaaattttcccagagaagacgacgttcaaactataatctgacgtaaggttggaaagccaggaaaaggaatatgaaatgaagggagaaagttccaaagaacgggaacaacatgtgcaaaggtcctgttgtgggtgagaataaagcaatttggaggaattaaaagccagtggagtatagaattctagagagatatggattgagcattcctaacctgaaatctgaaatgctccaaaatctgaaaaaaaaaagtattttcttattcttttttgtcttcttattaagagatggggtttcaccatgttgctcaggctggtctcaaactcctgagctcaagtgatcttctcacctcggcctcccaaagtgctgggataacaggcatgtgtgagccactgcacccagcccaaaatttgaattttttttttttttttttttggagacagagtctcactctgtcacccaggctggagtgcagtggcaccatctcggctcactgcaacctctgctgcaggttcaagcaattctcctgtctcagcctcctgagtagctgggattacaggcatctgccaccatgtccaactaatttttgtatttttagtagaggcgaggtttcaccatgttggccaggctggtctcaagctcctgacctcaagtgatctgcctcccttggcctaccaaaatgctgagattacaggtgtgagccaccatgcccagcccccaaaatttgaaaacttgagtggtgacgtgatgccacaagtggagaactctgcacttgacttcatgtgatggattgcagacaaaacatgggtagaaactgaaagcctgccattgtttgttattgttgttgtttaacagctaatataggtattctggggatgatactgccctatttaggtaccctgaacacattattttttcactgtattaagggtatgccatactttttactgttaagtacttaagtgtgaatggtataagaaaaaaattgcttatgggtagcatatatattcagagacaggaatgatgatgatgccagacaatcacagattgtccatatcagtagctcacatggtgacacctctgctttctgatggttcaatgtatacaaactttgtttcatgcataaaattaaaaatttgtattaggtcggtgcaaaagtaattgaggttttgcctttaaaagcaatggcaaaaacttcaattacttttgcatcgacctagtataaaattatcttcaggcagggagtgatagctcacacctgtaattccagcagtttgaaaggccaaggcaggcagatcacctgaggtcaggacttcgagacaaccctggccagtatggtgaaaccttgtctctgctaaaaatacaaaaaattagccaggcatggtggtgggcgcctgtaatcccagctatttgggaggctgaggtaggagaatcgcttgaacccaggagatggaagttgcagtgagctaagattgcaccattgcactccagcctgagcaacaagagtgaaactccatctgaaaaaaaaaaaattagctgggcgtggtggcatacacttgtgagctcagctacacgggagctgaggcaggataattgcttgaacccaggaggtgaaggttgcagtgagctgagattgctccactgtactccagcctgggcgacagagggagactccgtctcaatcaatcaatcaatcaatcagtcaatacaattatcttcagcttaggtgtataaggtgtgtttaaaggctgggcgcagtggctcatgcctgtaatcccagcactttgggaggccaagacaggtggatcacaaggtcagcagatcaagaccatcctggctaacatggtgaaaccccgtctctactaaaaataccaaaaaaaaattagccaacatggtggcacgcacctgtagtcccagctactcgagaggctgaggcaggagaatcgcttgaacctggaaggcggaggttgcagtgagccaagatcacgccactgcactccatcctgggcgacagagtgagactctgtctaagaaataaataagtaaataaataaaaataagatttgtataaaacaaatgacttttgtgtttatacttgggtctcattcctaaggtatctcattctgtatactcaaatattccaaaatccaaaaatgtccaaaatctgaaaaacttgtggtcccaaacatttcagatgagagatactcaacatgtagtagtgagaaaagaagctaggaaggtggacagacaccagttccaagagggccgctcaaactgtaataaggaaattgaactttattctgagggaatgagaagtcacagtaacatttatgcagaggacggaagtgatgctacttaaactgtagaaagatcaacctaactgcagtttggagaatggtttagaagggaggaaaagtgaaggtggagaacccagtaaggagacaaaaccaattagccttcctaggtaaccactttggaatgaaaagttgaatgaaaagttgagttttgttttcttatgcagtgtacaatttttgtcttttgtcttgccttgaagcagttttagtgtgatatgtctagatgtggctttctttatatttatcttaatggagtttgtagaatttgttgaatatgtgttttgaggtctttcattagcttggaaaattcttggtcattatttcttcatctattgcttttgtttcattgtcgctctcttctccttctgggacattaattacataaatgtgagaccttttcaccaaatcacatttgtctcctatgtttgtttttttattttataatttttttttgagacagggtttcacactgttgcccaggctggagtgcagtggtgtgatcctagttctctgcagcctcaatctcctgggctcaaacaatcctgtcacctcagcctcccaagtagttgggaatagagacatgagctacctgcctggctaatttgtaaaattttttttgtagagacagggtctcactatgttgtccaggctggtcccaaatctcctgggctcaagtgatcctcctgccttggcctcctaaagtgttatattcttctgtctcttcatgctaatctcaatatgttcttctgcctctcttctcattcacagattctccctcagctatatctaatcttctgttttttttttgtttttgtttttgtttttgtttttgagatggagtcttgccctgtcacccaggctggagtgcaatggcgtgatcttggctcactgcaacctccgcctcctgggttcatgccattctcctgcctcagcctcccgagtagctggggctacaggtgcctgccaccacacctggctaattttttgtatttttagtagagacggggtttcaccgtgttagccaggatggtcttgatctcctaacctcatgatccgcccgccttggcctcccaaagtgctggaattacagatgtgagccaccgcgcctggcctaatctgctgttaagtctacttattgtgttcttaattttagttattgtatatatttctataaattcacttcaattttttatgagttccacatctgtgctgaaactatcttgtcatttaatttctcgaacatattaatcacaactgttttatagtttgtgtctgataacttccatacctggatctcttgtgggtctgtttctattgtctgattttttctcttgattatcagtcacttcttatatttttatcagcatagttttttgaaatggaaaattgtgttttaaaaactatagagatgacctgaggttctagttgatatgttatttaagggaggattcactttagtttcaacaagcggttgggaatacatataataagcaacttaagtcctgctgtgcctcctcactggccacgctccttccaggcaccagcttctctgagccaccaacctgcggctgccctggcccacctgcgcctctggcagcaccatgacagatcaggtctttgtgacactgaccacaaatgatgcctacaccaaaggtgccctggtcctgggctcatctctgaaacagcacaggaccaccagaagactagtcatgctcgccaccccgcaggtctcagactccatgagaaaagttttagagacagtctttgatgaaatcatcgtggtagatgtcttggacagtggtgattctgctcatctaaccttaatgaagaggccagagttgggtgtcaggctgacaaagctccactgctggtcacttacatagtattcaaaatgtgtattcatgggtgcagatactctggtcctagcaaatattgatgatctttttgagacagaagaattgtcagcagcacctgacccagggtggcctgactgcttcaattctgaatttatcagccttcagttgaaacatataatcagctgttgcatcttgcttctgagcaaggtagttttgatggtggagaacaaggcatacggaacacattttttcgcagctgggcaacaacagatatcagaaaacacctgccatttatttatagcctaagctgcatctctatatagtcctacctcccagcatttaaagtgtttggtgcaagtgccaaagttgtgcatttcctgggacaagtcaaaccatggaattatacttatgatcccaaaacaaaaagtgtcaaaaatgagtcccaccatcccaacgtgactcatccagagtttctcatcctatggtggaacatctttaccaccaccgttttacctctgcttcaacaatttggccttgtcaaagacaccttctcatacgtaaatgtggaaaatgtctcaggagccatatcacatctgtcccttggggggatcccagctatggcacagtctgtgtatcctcagaagaatggaaggagcggtgggaacagggctagaccgattatatgggagcagattcctttgacaacatcaagaggaagcttgacacttacctccagtagaaacactgcattttcctgtggacacatccacttcacaagccttgtttctgatacttagtatctagagctgggttgagaaaagtctgttatggttgctagagattttcacaaaaacttatcagatgagaggtttttgtaggacaacaggtgagaactgggcaaaagttgtgaagcagcaattccgttgttacatggacagtgttttgctttttaatcctgtttagcttgtttcagaaattctcacttttgttgactgccaacatacaaagtaggggaaactcaatattaagctgttaagatggctgcatcaattcttaaaatctgcagagcctggttccaaatcagtcactcccttcagaagcagacatggcatctgatccttgcttgcttgctggttgtacctacctttcactagacctgcattttggaattgcccagtgctgccagagtgagtgattgtaattctgttttcaggtaaagatagcttatattaacactgctgagtgattcataaacgtatcaacaaatagcattaacccattttatttcctggtcttagtgtctgaagatgttcaccagttttctatgtacagtaaggcagcatgctaaaatgcttttgttcagtctgtatatttgaaaatagcaaggtgttctctgatggttacctgcagtggaaccctgtatgaaaaataaagacttactgccataaaaaataaaaaataagcaaactttgggaggccaaggtgggtggatcacaaggtcaggagttcgagaccagcctggcaaatatggtaacaccctgtctctaatacaaaaatcagccgggcgtggtggcgcacgcctgtattcccagctactcggaatctgggaggcagaggttgcagtgagctgacatcgtgccactgcactccagcttgggcaacacataagactccgcctcaaaaaaaaaaaaaaaaaaagcaacttaattcaatcagggattaggagggtttctgtgggtttctggacctcagtctttgtgagggctagtctatttttggcccatcttacttgtaggattctttagggttcccaactggtttagttgttcattgctgtatctcaaaccacttcaatatttgtggcttaaaacaatagtgatttctggcaattatctgggtcgactgaacagttcttcatttggtattggctgggatcattcgtaaagctgcattcagctgggcacttggctggggcattttagtaagttttcacatggcatctctatacaatattccatccccgagggcctctccacatggcctatttctccactgggataaccttgacttaagcatggaggctagattctaacagggagaaatccaaaagtacaagtcccagtgagcaagttcatatttaatctttgtttgtttcacctttactaatgtactattgataaaaacaaatcacataagccagatgcagtggtgtacacctgtactctcacctactcaggaggctgagacaggagggttgcttgaggccaggagattgaggagggagtgtgctatgatcacacctgtgaatactgcactccagcctgggcaatgtagccagacccccatctctcaagacacaaacaaaagaaaacaaattatatggctaagcccgaaaccaatgtgaagaggaccacccataggcataaatcctggaaggtttggttcactagcagccagctatgtaacatattaccatatcaaatgaaatcctatggtgcttaccagagtacctcctctttaatggctcctgatctccaattcttgtcatctcagccctgtaagctctcttcagcttttgggcttctcagttgctgattaggaatcagcaaaaacattaaaggaaaagcaataccaaatgatgggttcacctctctgtacttcctttctctttgggattggtcctttgagttcacgttttcttagaaactttccagtgccttcaaactggtatttcctgtattcttcccagcttttctagttgttctcagtaggagggatggtcttaagcaagctgatctgtattgctggctcacagtggccaggggagtagaaagagctcaaagagaagtgactggttgggtcccaggacttctagtctcagaaaatccctcagtctctagcagggcagggcagaggagccccagaaccacctttcctcaaagtactttagcctatgcaagcttagactgttgtcctttcactgttaaccagtattaaccagttaaccagttcttctgcagacaaaagcatcaggaagtacccaccatgtaccagtgggcccttcttgatgctcttgattgcagaggagccctgcaacctgaataaatcctcctggaaggtaagtgggggagccctaattaaaactgtaattcaatgtctcgatattttggcaaatgaaggttcaggtgagttttaattagtttcagaaaaagcaaagtaaaatgatatttaatgtactggattttgatggatacaaatctatatccattatatactatatgtttgttttttctaaaaaaaaaaaaaaaaaaaaaaaaggcaaccagaaaattgtcatcaatgttcataccttgaatactctaattgagtattgactttttttggtaacagctttcttgagatgtataatttacataccatacaatttacccatttaaaatgtacgattctagttttcaatgcattcacagatatgtgcaactatcactgttggcaatttcagaacattttcatcacctaaaaggaaactctgtagcctttagctatcactctcccatttccctgtttcccccaacgcccccagagataagcaaccactaatctacttttggtctctatagatttgcctactctagaaaattcatataaatggaatcttatgtgatcttttgagtctgcttctttcacttagcatacctttacaagatttattcatgttgtagcatgcattagtacatcattccattttatggctgaatagtattccattatatggatattttgtttatctattcatgatggacatttgagttgtttccaacttttgggtattatgaatgatgctataaacatttaagtaaaagtttttgtgtagatatatgttttcatttctcttggacataaacctaggacttggattgcgggtcaaatgttaattctatatttaattttttgaggaactgccaaattgttttccaattttatattcccaccagctgtgtatgagggttttgatttctacacatcttctctaatacttagtaataagtattaagtatctgactttttttttttttgagatggagttttgctcttgttgcccaggctggagtgcaatggtgtgatcttggctcactgtgacctctgcctccagggttcaagtgattctcctgctttagcctcctgagtagctgggattacaggtgcctgccaccacgcctggctaattttgtatttttagtagaggtggggtttctccatattgttcaggctggtctcgaactcccaacttcaggtcatccgcccgcctcagcctcccaaaatactaggattacaggtgtgagccactgtgcccggtgtttgtattttttttttttttttttagtagaggcggggtttcaccgtgttggtcaggctggtctcgaactcctgacctcaagtgatttaccctccttggcctcccaaagtgctgggattacaggcatgagccaccacacccggtcaagtcttgtccttcttcaggacatttgtttctaaatattttaccttttggtgctattataaatggaattgttctcttaatttcacttttgaattgttcattgcaagtgtataaacatacaattgaattttatgtattgattttgtaacctgcaaccttgctgaatttgtttattatttataatagtttttgtgaattccttaggatttttaatacgcaagatcatgttgttatcttgtatattaatgatatataagataatatatctttccaatctggttgtcttttatttatttttcttgcctaattgccctgactagaacctccagtagagtgtagaatggaggtggtaagagcagccatccatgtcttgctactgatcttatggggaaaatacccggtctttcaccattgagaatgatgttagctgtgggtttttcatggatgcctgtatcaagttgagagaggtctcttttgttctttttttccttattattatttttttatcatgaaaggtattggatctttgtctccaaatgctttttcttcatctattgagataatcatgtcattaaaagaattctgttgatatgatgtgttgcattaattgattttcagatattaaaccaaccttgcattcctggagtaaatcccacttggtcgaggtgtataattcattatatatggtactgggattcagcttgctaatgttttcttttaaagcatagtggccaggcacggtggctcacgcctgtaatcccagcactttggtaggccgaggcgggcggattatgaggtcaggagatcaagaccatcctggctaacatggtgaaaccccatctctactaaaaatacaaaaaattagccaggcatggtggcaggcgcctgtagtcccagctactcaggaggctgaggtaggagaatggcgtgaacccgggaggcagaggttgcagtgcgctgagactacgccactgcactccagcctgggcggcagagtgagactctgtcttaaaataaaaaaacagaaaaacgataatattggggaaagagagcaattagttttatttttttaattttttattatttacttcattttatcatttttttttgagatggagtctcgctctgttgccaggctggagtgcagtggcatgatctttgctcactgcaacctccgcctcctgggttcaagtgattctcatgcctcagcctcccaagtagctgggattataggcacgtgccaccccaaccacctaatttttgtatttttagtagagatgaggttttaccatgtttgccaggatggtctcgatctcctggcctcatgatctgcccaccttggcctcccaaagtgctgggattacgggcatgagccaccgcacccaacctattttttttttttttttttgagatggagtctcattcactgtcgcccaggctggaatgcagtgttgtgatctcggctcactgcaacctccacctcctgggttcaagtgattcccctgcctcagcctcccaagcagctgggattacaggtgcatgccaccatgcctggctaatttttgtattttttgtagagacagggtttctccatgttggccaggctggtctcgaacttctgacctcaagtgatctgtccccgctccttggcctcccaaggtgctgggattacaggtgtgagccaccgtgtctggccaagagcaattacttttataggaatctaggttctgagtctgtgctgggaaaaaaaaaaaagtcagtatggtcaatggagaaagcttgaagaaaaataattcttaagtttccctgtcccttagtaaagacagtatattcctcaatggagagtcatttgaaatttaatgtggtattgtccttcacttaagaaataatgtgattgataatctgactgatctaatgacaacccaacattagcttttagctatttttccagcagcagcagcaatgagttgttctcagcccccatcactaaggcagacctatttcctgggcactgcaaattggttccactgcctccactttggaatacattttacttatagtagttgagctggattcatacctgatagtccatagcattaaaaaatgcatgatattggattgtcaaatagagaggagacatgggagttaagaccaaggttttgactaccaaacccaggacttttccttgattcattaggcaataggcaaccattaaatgttttgagtcagggaataccatgattgaagctgtactttaagaagattaaactggcattagtgcattggatataaaagatcaaataaacagctgggtgatgagaatgaaaagcagcttgcagaagtaaggtaaattctgcaggagctggtaattagatttgatgatcaagggaaagggaagactactagattttaagactgggtaattgaaacaatactggtggtattttctgaagtcagagttcgactagaaggaaaggtgatggctttggccttagatgagttgagatttaactaggaaagtttgcctgcagacttccacaatcatatcccatgcaaacaattggaaacaaaacagccaaagctaataagcatttacaaggaaaggacactggggctatttaatttagaaagtgaaaaaaatttagcaaaaaaagagaaaggtgaaaggatctatttatttctctgatgacctagttcctagcctttaactcagcatactgacctacccgtgacactatatgccaggtgaagcaagcaaagcttgttttgggagaagtgccccaagcacacactgtcctttttgagatggagtttcactcttgtcacccaggctggaatgcaatggtgcgatcttggctcactgcaacctctgcctcccaggttcaagcgattctcctgtctcagcctcccaagtagctgggattaaaggcgcctgccaccatgcctgcctggatcattttgtatttttagtagagataagggttcaccatgttggccacgctggccttgaactcttgacctcaggtgatccacccgccttggtctccaaagtgctgggattacaggcgtgagccaccaggcgcccagcccacaccatccatttttaccccattgatcctcattttcatctccctgctcctggatagctggttccatattccagctttccatattgcttttgatctgcattgtggtctcttctggctattggatacctctttccatgggctcttagaatgctcagatttcagcaattgcatagtttctagcagaagacttcctctgccagtccagcccctcaaaaccctcctgctcagattggccccagaatctctgccaggagatggagattggggcagtttatcttaatttgattagcaggtttagcttctgcaaagcacattcttacaaggaatatttgagaatatgtagtcataatgtaacagcttgcagttctctttcttattctataactgattgaaaattctaataagaaatatgtgtaccttgatggcaatgttgaaactcagttgtttagaaagatggactcccctatatttagctgaaaaatcagggtttgaggcttttagttccctctgaaaccatgaggacttagcccttgagatccagtttaattctaacatgatttagaagtctgtttcatttccctgatgttgagtcaccaggctggattaattttccagggtgttgtgctaattataggttagtggaggaatgggctaaaccaaaatggcaacaagcgaaaaagtagcaggttactctgagtgctgctggagtgtaaagctatttataacatcacaattgaatggctactattaattaataagcatcgcagtgaccttcaattttcaaagacgttcaccatcattttctagttaatctttcccatccattactgcattcgttttatatgaagggcagagctgatgaattacttgcctgaagtcatgtctgtggttaagccaaaattacactttaaacagatgaataataataaaaataatatatttgtggagtgtttttcaattttcaaaggatcttttccttcgttattttatgactctttattcttcatgcttactaagcatccctatgaaggttttctgctggttagctcaggatagcagaagagaggagggttcagtttatgggtatcttggttaaatttgaactgaataggaacataagaaacacaacattcaggagtttagaggtctgagttgtatgatctttgttcctcatcacctttttttgttaggttttcttggcctttgaggacccatagagcaaacattcagtcacattaagtctttgtttttcaaggctttgattttgttccattcaaacctaaaatgtatgaatccgcagaatttgatgtcaaaagaagcctcaatttaagaaagtttggttaatccaaagattacttacattagaatactggaatacaatctccaaatagcttagctgatcctggtgtctgctctgaaccttcatgctgtataccatttctgctccctttttctcactcaacacctgggcttttcttgacccttatagacccaggatgtccatacagtacagttgatcctcccagaaccttctatactcccacaagcaaagaaacacatagttgcatggatgcttaaaaggtcatagagtctaacattgtcatcttacaaataaaggaactgaggctcagggagtagaagtgacttttccaagtcttatagtaattgccagcgctggtgtaaaagctgtcagacttttgctcctgtagaaaaggaactgaaaggcatcagaaagtcaaactctcactgcagcaatatttaccgtagcacaactactgagttagccacatatatcatagagcagttcccaagatgttcacggatgttctttgacatagggttttgtggtcatattactttgtgtagttgggaattcatgatgcagagttgaagattggaaactctggaaagtctcttaggaaggattttgttaagcatttctcaaatcatttcttcgttattttcttcccaaagaaaatctagtaacagctcgtgtaattagtgttcattggtgatagtgacactttgatgaacaaatacatggtgtctgttaaagcagataccaagcagtcacaagcaggctgaactgttgagttctttgttgcaggttattttatcttcacaacatcttaggattaggtattactattcctactttacagatgggctttggacttgttgcatgtgacagaaattgagctcaaacttgcttcaaaggaaaggagtgttattagttcctggaactgagaagcttggaacattgaaaccaacaacgttctttctcctatctgtgcttctgtctttgtcaagtctattcatcccttttacagacagatgtcctcacaagaatgaggatatggctgtgcacagcttagattcactccgtaacactgcagctagagacgaaaggactactgccagccccacttaaccagatcctggagagggactctggccagcaaggccagcccctctgctgtctgtctctgtggaggaaaatgggtaccattgttaaccgaaaggggtcctgatccagactccaagagagggtttgagaacgaattcagggtgagtccatagagtaaagtgaaagcaagtttattagggaaataaagaaacaaaagaatggctattccataggcagagcatccctgagggctgctggttggctatttttactgttatttcttgattatatgctaaacaaggggtggattattcatgagtttcctggaaaagggaagaaccccagaactgagggttctactccctttcagaccatatagggtaacttccagatgttgccatggcatttgtaaactgtcatgatgctggcgtgtgtcttttagcatgctaatgcattataattagcatataatgagcaatgaggaattttgtcaccactttggttttggtggggtttagctgtcttcccctgccccccacccccccaatccagttttatccgcagggtctttgtgatctgtatcttgtgctgacctcttatcttatcttgtgacttaagaatgcctaacctccttggaatgcagcccagtaggtctcagccttattttacccagcccctattcaagatggagtcgctctggtttgaatgcttctgacgccgtgattggtttagactcaatctcacactctctttgtggcataggagatgtgttttcagaaatccagaaaggagcttagacaaaacagtagtctcagggaacatagctagttaagtgatggaactgagatttgaagtcagatctgtctgactccaaagtccatgttttttttgtttgttttctctgtggtttgttgtttctatgatgtggcttctgtcaccctgactctccttttgtcttttgtccctcaccaccttctgtagtttcccagtcctcctgactcataccagggaagcctcctgtgtccatatacaatgaaggctcagggacttctaactcctggtggactggctgattgagccctggaagtgtactttctccttcatttccctcctgactctcgctgggagagttgtagactcctgggaaacacaggtctatggcctgcctaagagaggaccagcccacaccaaagaaagtgccactgcctcctcctcctcagtggatgccaccaagccccgaggaggacaaccttttccttaatctccttgaaacccaggcaaactttgacaaaaggaaaggtgtttccagtgtgttgttaactgaaccttggttgcttggcagtatgcagttcttgtctaatttaccccaaggaaatgtctgtgtgatgtatttttaatttgctgaagaaggataagtgttcaaacctttgtacatttatgctgaaattaatttttcaaagtccacataacttcagtgctgtgggatagtccttaagaacagaaattatgaccaaccataataaatgacacatttttgtgaaatgtca

SEQ ID NO: 263 - DNA, 2047 bp, Homo sapiens
ctcccggaagcggcacgggaggcgaccgtgctcgccgttggcaggctagggttggcggcggcgtattctgtttgttttaaacgaaggagcggagggaggggccgcgccgcggagcgtgcctaaggtgaaagggctgccgtgcagccaggcagaggcgaggaaggcttctccatcgtcgccaccgcccgcctgtttcgccggcaacaggttcccccgggacgggaggggccgcagcgccgcgcagctcgcagcgctgaacgtcgcggaaatcccttggccggccgagcctccgcagccgcgacccggcttctctccgtccgagtcccccgagcctctccgaacccccgttggacttcccctccctggccggcgccgcccgacccgctcccccatcctagagggaattccctgcgccgcggctgtgaggcacctccaccccggcctgaaatgcaccgcagtcctgaaggaaatccaccctcatcccacgcagattcacccgcaacgctgcctgaatacgcctcgctgcccacagaaattcctgcccaaaccagacgcgtggaccacccaagacgaaattcacactcgaccctagccccgccagcccttgccgaaatcaccctaaacccgttgaaattaattcccagctgtccgaattttccttccaacattaactgactacctgtctccgccaagctgactgaactctaccgaactcttaccctgaaagcccctgagagtccaaaatatatttttccagcccgaaatctaaatcccagttctctgtatgaaaacctccagaaacccagactcttacttccttcggccacggactcgttcgaacatcgtggacatcaccttcccacatttttaccgcagtctttggctccgattctttgtccctgcctcttgggcagcatcctatccctgtttctttccacctttgaggattcctctacctctttaaaggcctgctttctttgctttctcttctcacctttggcattggcacactggggtcatatctttagttcccttgactccaccatctaagccaagggtgtccaatcttttggcttccctgggctacattggaaggagaaaaattgtcttggaccacatataaaatattctaacgctaatggtagctgatgaaacttttaaaaaatctcatcatgttttaagaagtttacgaatttgtgctgagccgcattcaaagccgtcctgggcctaagtccttgctatttttcctcttcaatttccttcaatccatagttctctaggttattttcccaccctttcccaagattcggatatcccttcattcttgctgagttcatctcctatgcctattcctacatacttgctgagttcatcttctaatgtcctcatcctggtttcttcctgaacctgaaatccagctaaccttactttttcatcccatcaaacccctgctgttgccagcccagcactcacgaagatctttacatacaccaaatattaaattagggccggtacctagacattgtctctgcactctgctggcatattttcccctggaccacgaacccttcgtacctagtaacttgccacctgtgtttataaataccagcaatttgatttacagggtgaatttgtcactattgtttacttttaaatgaagttactgtatttgttgtttccattaaaggcgacattataaagcctaggcctcatatccaaagcaaataaagtctcaattttttaattaaaagtaacaaaaggaaacctcacacttctgaacaacaatgacaagaaggaatgcctataattggtttgggtcacaatgtacatattgaaataaaatttttattaagtatcaacttccaggtacacaatgaagttttaaatgtttatctgtgacatatgaagaacaaagcaatctaaactgatgtaagcaggctgtcataaggtacatgctgaggaatttattcaacaaattgaataaatttattcaataaataaataattattcaataaataatatatttaataaatttaataaatagaa

SEQ ID NO: 264 - DNA, 2233 bp, Homo sapiens
gccatcctagcagccacaggaaatagtaaatgaatgcatgcggcagtgttccaataaaactttatttacagacactgaaaactgaatttcatatgattttcataagtcacaaaatattactgttttggtttttatttaaccattgaaaaatgtgaaaggccaggtgtggtggcttacacctacacgcgtgattacaatcttagcactctgggaggccgagggggcaggatcacttgagcctagaagtttgagaccagcctggacaacatggcaagacccatcttgacaaaaagaaaaaagaaaaacgtaaaaaccattcttagcaggccataaaaaacaggtggcatgacagatttagcttatgggcaataaatagtttggcaaccctgctttactaaggtaaccaaaatagatttgggtgtcctttcctgttactggatgtcttttcctggtacttgttaaacaattctgtatgtttacatcatgttactaaattgcctgtgttttattagaacactgtagctcacacaggcagaaacttagatatacacacagctgtgtaaacttaaaagccaattaagtaagaaaggttgggaagtgcccctacaaatccaaaccctagctcaagagttgcttttcctgatagtttcctgaaatgctgtgagccaggccctccctgcccgctcctctctctgatgtcttaaagcaaggactgtaccatttatttgatgctcagccacctcccttccttctttattccttcctttttcactctgtgttttgacttgccaatagacctatatcttcctggcatctaggcaggtaccacatctgaaacctttgtatactctccgcattgtgggtgacagcaatgaccctgaagtcagatagattttgttcacatcccagtttcactagttaccagctctgtggccttgggcaaatgacttgatctctcccaatttggtttcgtcagctgtcaaatggggataataatagtatctagctcacaggtttcccatgaggtttaaatctaacgatgtatgtatgtaaagatactagctctgtgcttggtacataagtcttcaatgatgctaactaattaaaattagcacaaagctaaaacccccatcaatatatgtgctttccttattaaagttaattagaacaggacagaaacatcacagttgcaattctttttttttttttttttgagacggagttttgctcttgctgcctggtctcacagttgcaattctttttttttttttttttttgagacggaggtttgctcttgctgcctggtctcacagttgcaattcctttttttttttttttttgagacggagttttgctcttgctgcctggtctcacagttgcaattctttttttttttttttttttgagacggagttttgctcttgctgcctggtctcacagttgcaattctttttttttttttttgagacggagttttgctcttgctgcctggtctcacagttgcaattctttttttttttttttttgagacggagttttgctcttgctgcctggtctcacagttgcaattctttttttttttttttgagacggagttttgctcttgctgcctggtctcacagttgcaattcttttttttttttttttttgagacggagttttgctcttgctgcctggtctcacagttgcaattcttttttttttttttttgagacggagttttgctcttgctgcctggtctcacagttgcaattcttctaagaatcatcccactgccgggcgcggtggctcacgcctgtgatcccagcactttgggaggctgaggtgggcggatcacctgaggtcaggagtttgagaccagcctgaccaacatggagaaaccccgtctctcctaaaaatacaaaattagccaggcatggtggcgcatgcctgtaatcccagctacttgggaggctgaggcaggagaatcgcttgaacctaggaggcaggggttgcagtgagcggagatcgcgccattgcactccagcctggacgacaagagctaaactctgtctcaaaaaaaaaaaaatcccacttaaggcaaccgttttcttcttagaaatatgaaagtaagaatttgctttgttttttggatttttctcctccaagaacaccagaaaattctattctaggcaaacagatcttgttgtcctgacaacagattgccaagaaaataagtaaacaaagcatctga

SEQ ID NO: 265 - DNA, 17019 bp, Homo sapiens
aataaaagcaggctgcggagccagcagcgacaatcggttggggtgtttttcaggtgtgtgggtggtttagttttttcgctgtttggggccatattgcttttatgagctgtgacactcaccgcgaaagtctgcgaagcttcattcatgtaagcccccgagaccacgaacctgccgagaggaacgaacaattgtagacgcgccgccttaagagctctaacactcaccgcgaaggtccgcaacttcactcctgagccagcgagaccaggaacccaccagaaggaaaaaactctggaacacatcggaatatcagaaagaacaaactccagacacgccgcctttaacaactgtaacactcacagcgagtgtctgcacttcattcttgaagttagtaagatcaagaacccaccacttccggacacaaaagtaaggggattacaggtgggagcccccgcgcctagcccaaactggcgctgattcttcatttgtatatcgcagttagtaaaagggctccctgacccctagccttgaatttggggagtaatttgatattcttgatcatcactacctcctttgtaatatattctttcaaagtatgtctgtttccctttcccccagtacttgtcagtattttgtttgtggggcgcggggggggtctcattctattgcccaggctggagtgcagtggcgtgatcttggctcactgcaacctctgcttcctgggttcaagcgattcttctgtcttctgagtagctgggattataggtgagcgacaccacgcctggctaatttttgtatttttagtggcgatgaggtttcatcatgttggctaggctggttttgaactcctcacctgaagtaatctgttcacctcggcctcccaaagtgctgggattaagaggtgtcaaccaccgtgcctagctaaatgtttgcattttttatggagacggggtttcaccatgttgcccaggctggtctcaaactcctaggctcaagcaatctgcttgccttggcctcctaaagtgctgggactgcaggtacgagccactgcactcagcctaaggcattttcttttctttaaatttatttttatatcttactttattcatttatttttcgagatggagtcctgctctgtcacccagggtggagtgcagtggcgtgctcttggctcactgcgtcctccgcctcctgggttcaagcaattctcctgtctcagcctcccgagtagctgggattgcaggcatgtaccaccacatctgactattttttctatttttagtagggacagggtttcaccatgttggccaggcgggtctcgaactcctgacctcaagtaatccacacgccttggcctcctaaagtgctggcattacaggcgtgagccaccatgcccagctgtattttattttatagagacagggtttcactgtgttacccaggttagtcttgaactcctggactcaagtgatcctcttgccttgacctcccaatgtgctggggttgcaggcgtgagcccgttcccagatattttctgaacctttgttcagaaataccaatggtgaataggcagtggacaacatttggggaataggcaggaagtggggaaggtgcggagggggtggagatgaacacccaaactctggggccttgcctctcaaattttagacaccttgaaaatatacctgattccaatctcttacacaaatggtaaacataaataggaagatagcgcatttggcaaacaggtgccaagcaacagtcttgaacagatgattgaacatttcatttgtttctctgttaataattaatccatttggaatgtaaatttccagctaatcttttaactcttctttagccactctagagtaataggaaaagggtagtaagcttctggatttgatttttcctaagtacaaattatcctgagaactcaaattacatgatttttctttttctttcaggaaaagcattcaggtataattaagtcgaacaacatcgtgcccataattttccacttttaagagatggggtttcactctgtcacccaggctaaagtgcagtggtaggattatagctcattgcagccttgatctcctggcctcaagccatcctcccacctcagcctccgaaagtgttgggataataagtgtaaaccactgtgcctggtttactttctacatgttaacactagtgattaaatgaagattgaaaatagaaacatgctaggggaaaaatactttgaatgttatctatggctccactatattggagaagttgtcaaactttttacaaaatcaaaatgaaaaaaaagaccaaaaaaaatttttttgagtgtctcactctgttacccaggctggagtgcaatggtgcaatcaccatggtagccttcactgtgcaggctcaagccaccctaccacgtcagcctcatgagtagctgggaccacaggcacgcaccaccttgcgtggctagttttttaatttttttgtagaggcagggtcttgctatgttgcccaagctggtctcaaattcctgggctcaagagatcctcctgccttggcctctgaaagtgctgggattacaggtatgagccactgtgcccagtggaaaagcaaattcttttattttgtttagcttgttaaaaattgagatgaaattcatatgacatcaagttaaccattttaaagtaaataatttggccaggcatggtggctcacatctgtaatcccagtactttgggaggccaaggtgggcagatcacctgagatcaggagttcaagaccagcctggccaacatggtgaaaccccatctctactaaaaataaaaaaaaattagccaggtgtggtggtggccacctgtaatcccagctactcgggaagctgaggcaggagaatcatttgaacctgggaggtggaggttgcagtgagccaagattgcaccactgcactccaccctgggcaacagagcaagactacatttcaaaaataaataaagtgaataattcagcctgggcgtggtgctcatatctgtaatcccagcactttgggaagccgaggcaggcgggtcacctgaggtcaggagttataacagaccagcctggccaacatggcaaaagcctgcctactaaaaataaaaaaaaaaaaaaaaactagctgggcgtggtagtgagcacctgtaatcccagctactcgggaggctgaggcaggagaatcacttgaacccaggaggtggaggttgcagtgaggagagattgcaccactgcaatccagcctgggcaacagagtgagactccatcagaataaataaaaattttaaaaataaagtgaataattcagtaatattagtacattcaccatgatgtacaaccaccacctctaccttgtttcaaaacttcttcatcaccgtaaaaggaaaccccgtgtccactaagcaattactccctattcctccactctcctcagcccctggaaaccaccagtgtgctttgtgtctctatggattcatttataccgggcgtttcatacaaatagactcagccaggcatggtgaatcctgcctgtaagcctagcactttgggaagcagaggctggaggatcatttgagggcagaagtttgagactagactgggcaacagagcaagaccctgtccctgcaaaaacaagggggggatgtgatacagtatgtgacctttcgtttctggcttatttgacttagtaaaatgttacccagattcattcatgttgtaacatgtatcagtacttcatttcttatggttgaataatattctgttgtgtatatataccacaatgttttaatccattcatcagttgatggaaatttgggatatatctgtcttttgactcttgtttatagcactgctatgaacattcatgtacaagtatttgttctagtatatgttttcagttcttttgagtatatacttaggagtagaatgctaattccttttttttcttttttttttttttttttgggaaacagagtctcggccgggcattgtggctcacacctgtaatcccagcactttgggaggccaaggtgggtgaatcatgtgaggtcaggagttcgagaccagcctggccaacatggtgaaacctcgcctctactaaaaatacaaaaattagccaggcgtggttgtgcgtgcctataatctcagctactggggaggctgaggcaggagaattgcttaaaacccggaagcagaggctgcagtgaaccaagattgtgccactgcattccagcctggatgacagaacaagattccatctcaaaaaaaaaaaaaaaaaaaaaagaaacagaatcttgctctgttgcccaggctggagcacagtggagtaatctcagctcactgcaacctctgcctcccaggttcaagtgattctcctgcctcagcctcccaagtagctgggaatacaggcatgtgccactgtgcctggctaatttttatatttttagtagagatggtgtttcaccatggtggccaggctggtcttgaacccctgacctcaagtgatccatctgcctcagcctcccaagttctgggattacaggcgtgagccactgtgcgcggccaggaactacctttttgtattctaagagttagctccaaactagtcaatgctgaaggccttgacattacaattctcatttgtttctaaaatacataaagacgctaaaacaattggcttgatggaaaaaaaaagttcaactcaagataaacactgcatgatctcattatgtgtggtatccaaagaagtctaactcatagaaacgagagtaggttggttgacaagagccatagggagggagaaacaggagaattttggtcaaaggaaagtttcaattataagataaataaattctggagatcaaaaatatagcatatggtaaccgtaactaataataatgtaggccgggcgcggtggctcacgtctgtaatcccagcactttggatggccaaggcgggtggatcacgaggtcaggagatcaagaccatcctggctaacatggtgaaaccccatttctactaaaaatacaaaaaattaaccaggcatggtggcgggcgcctgtagtcccatctactcgggaggctgaggcgggagaatggcgtgaaccagggaggtggagcttgcagtgagccaagattgtgccactgcactccagcctgggcgacaaagcaagactccgtctcaaaaaaataataataaataataataacaatgtattgtatacttgacattttctaacacagtagaacttagtgttcttgccaccaaaaaacggtaattacatgaggtggtggatatgttaattagcctttcggtggtgatctttttttgacaacgagtttcgctcttgttcttgttgcccaggctggagtgcagtggtgccatctgggctcactgcaacctccacctcccgggttcaagcgattctcctgcttcagcctcccaagtagctgggattacaggcatgggccaccacgcctggctgaatttgtattttcagtagagacggggtttctccatgttggtcaggctggtctcgaattcccaacctcaggtgatccgcccgcatcggcctcccaaagtgctgggattacaggcataagccaccacgcctggctgtggtgatcattttacagtgtataaatatatcaaaacatattgtacaccgtgaatatatacagtttttatttgtcaattacacctcaataaagatgggagggaaagaaaaagaaaaatgtttaactctaccaaaaataaaagaaatgcaaatcaaaataagaaaaatgccattatttagactcagaaagccaggcatggtggttcatacctgtaatcccaacactttgggaggctgaggcaggagggttgcttgaggtcaggagttcaagaccagcctgggaaacatagcaaaactctacctctacaaaaaaaaatttttggccgggcgtggtggctcatgcctgtaatcccaacatgctgtgaggctgaggcaggtgggtcacttgacgtcaggagttagagaccagcctggccaacatggtgaaaccccatttctactaaaatacaaaaattagccgggcatggtggcaggcacctgtaatctcagctactggggaggctgaggcgtgagaatcacttgaaccgaggaggtggaggttgcagtgagcagagatcgcaccactgcactcaagcctgggtgaaagagtgatactctgtctcaaaaaaaattttttttttttaattagccagatgtggtggcacgtacctatagtcccagctactcaggaggctgaggtgggaggattgcttgaaaccaggagtttgaggctgcagtgagctgtaattgtgccactgcactgcagcctgggtgacagagtaagattctatttctttttttttgggggggtggggacggagtctcgctttgtctcccaggctggagtgcagtggcactgtctctgctcattgcaacctccacctcctgggttcaagcaattcttttgcctcagcctccagaatattagagggattagggttgggattacagttgcctgccaccatgcccggctaatttttgtatttttagtagagatggggtttcaccatgttggctatatgctggtcttgaattcctgacctcaggtgatctgcctacctcggcctttcaaagtgctgggattatagacatgagccaccatgcccagcttgatcctatttcaaataaataaataaaatagacacagtattggccaagatttgagtaaattaataagcgctgatcagagtgcagagaattgggctgtttctatacaaaaccaatagaaatgcaaattgatacacccattctctggaaaaatttgaatgtagcctggacaacatagcaagacccccatgtctttaaaataatgagaacatctgtgttctaacgcatagtgcttagcttttttttttttcttttttttgagaaggagtcgagctctgttgcccaggctggagtgcagtggcacaatctcggctcactgcaacctctgcctcctaggctcaaacaatcctcctgcctcagcctcccgagtagctgggactacagctgtgtgccatgcccggcctctggccagcatactttttaaaaattggaagactcggatgggcacggtggctcacgcctgtaatcccagcactttgggaggccaaggtgggcggatcacgaggtcagaagatggagaccatcctggctaacacggtgaaaccccgtctctactgaaaatacaaaaaattagctgggcatggaggcgtgcgcctgtagtcccagctgctggggagactgaggcaggagaatggcgtgaaccggggaggtggagcttgcagtgaactgagatgccgccactgcactccagcctgggcgacagagcaagactctttctcaaaaaaaaaaaaaattagaagactcagtaaatgttaagtctggctgttgtaattgtcagatgtacatcaaaatgctggtactgcttatctttaagtagtggaatcgtaattttaatattcttttgtacacttttctatatttctacaataatgcattttccttttgtaatcagaaaaaaaaaagaaaattaagatttcggtcctcatagccgtctttatagtcaactttctaagcaagataactttgcttaaggtaattctcactgctgtgggacagtgattccatattggataaaggcttcgatatttttggaaaggcatcccaatctttgctaccctctcttctaataagagtcgaggtgaacactatcaaacaactgaaaaatacttctatcaggtcagcgctccaggatatttctattcttagacataataagatttggagagcagtgctttagaggctgggcaagaattttagaaagctaaggattacaacagatctggacatttctcccccatccccattaacagtcatgaactgaaaatttctattaggggtcattcatttacaggaaaaacaacgaaaaccaagaaacttggattatgtcattcatctactaacattttttatggcacccctgtgcctattctagtacctacacattactcagccaggcatctgaggtcattttaaagataattttcaggcaggtgtggtagcttaggcctgtaatctcagcattttgggaggctgaggtgggagaattgcttcagcccaggagttccagaccattttgggcaagagggcaaaactccatctcgacaaaaattacaaaaattagccaggtgtggtggcgcccactggtggttccagctaatcaggaggctgaggcaggaggatcgcttgagcccaggggtggaggctgtagtgagccgtgactgtgccactgcactccagcctaggcaacagagcaagaccctgtctcaaacaaaaaaaaaagtgatattcagagcgacttgaaacatggatctgaatctaggtactggagtttccactttcagcttcgggactatcagttcacacccagctataaacatatcgagcaaattcctagaactcttctatgagtgtcatatcaatatacacacctgcatatgtgtactgctgagccaccgcgcctggccaaaagtatttttttcaagcgtctaatggtgtaataattagccattcaaattaaaggggccattctaaagaattagcttcagcaggtggtgtggctcaggcctgtaatcccagcacttcgggaggccaaggcaggtggatcacctgaggtcaagagttcgagaccagccaggccaacatggagaaaccccgtctctactaaaaaaaccatgaaaattagccgagtgtggtggtgtgcacctgtagtcccagctactcaggaggctgaggcaggagaattgcttgaacctgggaggtggaggttgcagtgagctgagatcttgtcattgcactccagcctggacaacaagagcgaaactctgtctcaaaaaaaaaaaaaaaaaaaagttgaagtaggggagataagaattaaatagaattgaatcagttgaaacaaaaaaaaattcaatacaagatgaaaagagctgttttggaaatcttggcagcagtgctgaaaagaaaaggctattttattaaccttttagcaaagacatagtcagatgtgtgttcaagaataccatttgaaattatagtcttacaaaattactacaggcagccaggaatggtgggtcatgcttgtaatcccaccactttgggagggcgaggcaggaggattgcttgaggccaggagtctgagaccagtctgggtaacatagtgagatcttgtctctacaaaaaaaaaaaaaaaaaaaacgggccaggcatggtgtctgtagtcccagctattcaggaggctgaggggggaagatcacttgagccaggaaggtcaatgctgcagtaagccatgatcttgccactgcactctagcttgggcaatggagcaagagcctgtctcaaaaagaaaaaaaaaaagtactgctacaagtattgtgactctagaaggtgtaagggtttcagaatgaggatggacaaaggttgacatttttgggaacaattattaggcacatgtatctcttttttttttttttttttgagatggggtctcactctgttgcccaggctgcagtgcaaatggtgcaatctcggctcttcgcaacctctgtctcccgggttcaagcaattctcttgcctcagcctcctgagtagctgggattacaggcgcacgccaccatgcctggctaatttttgtatttttactagaaatggggtttcaccatgttggtcaggctggtctctaactcctgaccttgtgatccacccacctcggcctcccaaagtgctgggataacaggcatgagccccccgtgcccagcctaggcacatgtatattcttacatgattgtaaatgaaggtggtgatggataagagtactaatctttttatcctgcatagtctgaaattggaattttcaaggcaactcttcttatcacaaccatctgaatgtctccttccctgaatgtctactttattcatttatcagttgataatgttcgtatttcattgcgtctgtctaatttggctataaatgtgcaagagcgtcagcctgtctgccttggattgtaaactgttagaggagagaggcaaggtttagctaattctctgtgtgaatcatttagcatggcatagcactacacacaatcaaggttttaataaatgtgttgattatgatctttgaaaaaaggcttagtcccatttatcgtcttctcgaccttgtcagcacttctcaagagggtggggagagttgacttaatctacatttttttttttttgagacagaatcccactctgtcatccaggctggagtgcagtggtgtgatctcggctcactgcaacctctgcctccccaggttcaagcaattcttgtgcctcagcctcccaagtagttgggattacaggtatgcgccaccatgcccggctaatttttgtatttttagtagagacagggtttcaccatgttgaacaggctggtctcaaactccacacctgaagtgatctgcccgccttggcctcccaaaatgctgggattacaggcgtgaaccaccgcacctggcctacttttaatacctgaagcttatgctaaatacgataactgcaacgtatcagtgacgtctgttggtgaatgtctgaaatgtattttcacatttctgtagctgtttgagatgatattacttatatggtacttggacacttgacttgaagtaaatatgttttaaaattgaatcacttcagtgtgaaattcaaattttgtggaatccaaaaatatttattttgacttttgccaactgttattggggatggaatgcctaatccttgaattgtaacttcaacagaaaggtctcattaccagcacaggggtgaacaaaggctcaaggagacaggagacttctatattttgcctcttaactatttttattacagtcagtgatgttaatctctaaaatatcccaataaattaatgtaatcactgcagttttctttttttttttttctttttttgagacagagtttcactcttgttgcccaggctgaagtgcaatggcacgatcttggctcattgcaacctccatcacccgggctcaagcgattctcctgcctcagcctcctgagtagctgggattacaggcatctgccaccacgcccggctgattttgtatttatagtagagacggggtttctccatgttggtcaggctggtctcgaactcccaacctcaggtgatctgcccacctcggcctcccaaagtgctgggattacaggcgtgagccaccatacccagcagttttctatccattctatcaatattctatgcattcattcatatttattaagttgtctattatgtgctaggttttgaaatgtataaagaagatgaaggccaggtgtggtggctcacacctgtaatcccagcactttgggaggctgaggtgggaggaacacttgagcccaggggtttgagatcaacttaggcaccatagggagaccctgtctcacaaaacttttttcaataattgtctgggtatggtggcatgtgcctatggtccccgctactcaggaggctaaggcaggaggattgcttgagcctaggaggttaaggctgtggtgagccatgtttgtgccactgaactccagcttgggcaacaaaaagaaggtagacatggtaactgccctcatggagtgtaaagtctatccagacaagtaaccagttacacagtgggctgcatttgtggatgggaggagatgttgactagagaggaacagacacagacacacacaaacacacacatttctgggatgacagaaatgttcttattttgttctgggtgagtacatgaatgtattcagtcatcaaaactcaccaaagtggccaggtgcggtggctcacgcctgtaatcccaacacaggcaggaagatcacatgaggtcaggagttcgaaaccagcctggccaagatggtgaaaccccatctctattaaaaatacaaaaattagccaggcatggtggcacacgcttgtaatcccggctacttgggaggctgaggcaggagaatcacttgaacttgggaggcggaggttgcagtgagtcgagattgcgccactgaactccagcctgggtgacagagggagactctgtctcaaaacaaaagcaaaactcactgaactgaacacttaagtttcgtgcattttattataccttaattgcacttcaatttaaaaaaaaaagcagaaaagaaaaaccaaggtagcaaaatagcgattataatacggtatgacagtgagtatcgtgtatgatgtacatgtgtatcagtgtgcctgacaactttaggagttaagagtacagctccttgagaaagtctacagagctggtagctaaaggttgattaaagatagccagtccaggaagccaatgaagcgcttcctctgaacttggaagagatggggaatttacatctcaaaagagcttgcctgtgcaaaggcccagaggtaggagagtatgacccactggggcactgcaagcagttcagtatggttacagtggaggttgtgaggtgagggtggtgggaagtaggcctggaggggtgagcagggaatggacgataaaggaccctgtaacactattttaataaatttggactttttcatgaggccattgggaaaccctaaaggaataaatgtgtgtgtgtgtgtatatatatacacacacacacacatttatgagtgagatcttggctcactgcaccctctgcctcccgggttcaagtgattctcctgcctcagcctcccaagtagctgggattacatgtgcgcgtcaccatgcctggctaatttttgtattttaagtagagacagggtttcaccatgttggccacgctagtcttgaactcctggcctcaactgatctgcccacctcagcctcccaaagtactgggattacaggcatgagccgccttgccccaccatcccaaaggaatttaaacaggaaaagacaaagtcagacttttcgtgtaaagaggcttttgtcctcaggatagagagcaaaccagaagtggggatgactaagcaggtggtgggggtggtggggtagtgcagattggagctcaagctcctgcagctgcaatgaagcaagagaaacagtaagagccatgggccaaggggatgaagaagtagatggatgtgagtggtgcacagggctagagctgctcaaaggcaaagtcaaggatgacttgcagttctctagcatggtgccatagagcatggtagggaacccaggaagaggagcatgggttggaaggaagtgggtactgagctgacaaatctgaaacgcagggaagagacggattggcagaggctcaggagacccatatacagacctagacagggaattcctgagaatggttacctatctggagtacagggtgaggtcatccagaagaatctgtcgagtgagaagtggaaaggcctgcaatacttgtatcaacaccaaaacttgaagggtgggtagaggagatggagaagaaattgctcagagagacagaaggaaaaccgagagagtagagtaggtggcccagcacggtggctcacgcctgtaatcacaacacattaggaggctgagacaggaggagtgcttgagcccagaagtttaagaccatcctgggaaacatagggagaccccgtctctacaaaaaataataataaattagctggatgtgatggtgcacatctgtaataccagctactcaggaggcttaggcaggaggattgcttaagcccaggaggtcaaggctgcagtgagccatcatggtgccactgcacgccagcctgggtgacagagtaagatcctgactcaaaaaatttatttatttatttatttatttatttatttattgagacggagttttgctcttgttgcccaggctgaagtgcagcggtgtgatcacggctcaccacaatctctgcctcccaggttcaagtgattctcctgcctcagcctcctgagtagctgggattacaggcatgcaccaccacacccggctaactttgtatttttagtagagacggggtttctccatgttggtcaggctggtctcgaactcccaacctcaggtgatctgcccacctcagcctcccgaagtgttggggttatagcatgagccgctgagcctggccaaaaaattttttaagaagaaaagaaatctgaaatctatttcatgttatatctgaaatagacatgatatgctttctcttagttttctaaaaaatatgtttaaacccttttctggtttagaatttactgtagtttggagtataagatttgtccaggtaaattcccaacatccttatcaaggagtcatcagatagtttccgtctttgaagcctgggttgtctttgaatttagagcaaagaatggttggagtttttccaaagttgccagcaaaaagcatgcgtttaagaggtcagacttggcttctggtcccatctttgcctgtagctagatgtgtgatcctgagcacacttaactcttctgggaggcactttgtcaatgtaaattgagaaagtacataaagtgaccttgaagggcccttctagctcaaaaactttatagcaaatgatggactcttttttttttttttttgagacgaggtgtcactctgttgcctaggctgaagtgcagtggcaggacctctgctcactgcaacctccacctcccaggttcaagcaattctgcctcagcctccagagttgctggtattacaggtgcctgccaccaagccttgctaattttttgtatttttagtagagacagggtttcaccatgttggtcaggctggtctcaaactcctgacctcaggtgatccgcctgcctgggcctcgcaaagtgcagggattacaggcatgaggtactgtgctctgccgggactcattattaagttcagaatttctagatcttagtgagactccgttcaagcaaaaccatactatgatacaacggttaacaagatgagaacctggcaaacttttaaatttttatttatttacttattattttttagagccggtgtctctctctcttgtccaggatggcctgcagttcctgaggtcaagtgatcctctggcctcagcctcccaagtagtgagaactatgggtatgtgccatcacgcttggctaaccaaccccctgcttaacctgagtttgcaaatgtcaaagttggagataggtcataaaatcgactcactggtagattttacagactgaatcttgctgtgttgcccaggctggtctataaaacttgggctcaagtgatcctcccatttgagcctcccaaagtgctggtattacaggtgtgagccatttcccccagccctgcaaataaacctattttctttttaaattactcagtctcaagtgttcctttatagcaacaccaatggactaagacgtatatgaatgtagatttactgtataagaatgaacttgttttggaaggtctgtctttttattggaagaatcgtaattctggtgagcatcatgctggactggggataggagagttggcagctcttctttcatcactgcctcactgagcctcaggcaagacagctcaccttcccaagccatgaaaagaagaaaaccctttctcctttctgcctgctaaggagggttattggagaaaaagcctgtaaagtgctccaacttcagagaaatatcaattggccctgtgttatttgtctcactctctggaaaccactttatttatttatttatttattttattttgtttttcgagacagtcttgctctgtggcccaggctggagtgcagtggtatgatctcagctcactacaacctctgcctcccgggttcaagcaattctgcctcagcctcccgagtagctgggattacatgtgcccaccaccgcacccagctaatttttgtatttttagtagagatggggtttcaccatcttggccaggctggtctcgaactcctgacctcgtgatctgcccgccttggcctctcaaagtgctgggattacaggcatgagccaccatgcctggccttttttttttttaatttatttatttgacacagagtctcgttctgtcacccaggctggagtgcagtggcatgatctcggctcactgcaaccttcgcctcctggattcaagtgattgtcatgcctcaacctcctgggtagctgggattacaggcacgcaccaccatgccagcctaatttttgtatttgtagtagagacagggtttcaccatgttggccaggctggtctcaaactcctgaactcaagtgatctgcccgcctcagcctccaaagtgttgggacataggcatgagctaccgtgcctggcctgggaaccacagaaagttctgtttctgtttcactttcaggattcttcagctatttggcaaagttgaagacataagttcccggttcacaaccattttctccattttacagagggagagacgtaaggcagaagaagattacatgtacgagttgacagcataattcactggcagaattccaaaaagatgctatcagtccaaaagaaaatgattctggggagccatctgttctccagctgcagagatgtttctctaaagtgcaataagtattgttgaaaccatctttactgtagcggaagtcaatcacagtctggattcagatgggagctggtttaagcattcagatgaagagatacttcgtcatttctaccagtgagtcaactttatgacctatctacaactttggcatttgcaaactcaggttaagcagggatggttagagagtttatttgatcttttaaattataaaacttatgcaatgagtccaaaaaagatggattaccttgagtaggtaaaatagttatatttgttaaattgaccaaggataaataaaaa

SEQ ID NO: 266 - DNA, 43 bp, Homo sapiens
agaaacccaaagaaagacaagagagagaaacagaggaataaga

SEQ ID NO: 267 - DNA, 6575 bp, Homo sapiens
gggccttaggctggtagaagttgctgctttcttctctgtgggctcctttctcgtggatctggaccccaggagttcccaggcatagagaggaggggtgccaggtgatgggggtgatggaggcggtggccacggccctggagaaggctgagccaggcaggggacagctatgggcagccttgaggttctgagagcagccgtgggcagcagtgggcagttgtcagttactctgtttatgtttaggtcttctgtaaaatcttgctaaacaatcgggtttgatctcatttgggttggggcaaattgagggaagagtctgtgttcaggtatagatcagagtttaaagaacaggcaagcctcaccatgccagggatacgatgacactagtgaggtccccgagggaaaggccctcccatggtggagaatctccctggctgctgccaaccttggagaatcgaggggagcatttgatcaggatgccagtgagggaggcagagccaccccagtgactgaagcccttctcagtgggttttctgcccaaagactggtcaaggattgtgtgccgagggtcaggggtgtttgtaaggacagagggagccagcagggagccaagagaatctgtcccagaaagcctaggtttaaactccagactccaagagtcagagcaggagcagagagtgggttacagaacttggggttgggaaaccttatcagtgttcttccatatctctttggtctcatttcctagccctgcgttggacccatccaggcatctttgctgttgcctgagcacatgaagccggcccctttttcccagcctttgcactgtactttgcctggaacgtgcttcccttgggtattcactttactcaagtcctctcaaatatctgagagagaggtctctgaccaccccatggaaaagaacaactcttacctatcccttacacattctcttactacacaacactaatttcctacaattatattctacagtatgtttatttgtttctctctttattgtctgtttgccacagtggagtgtaagcaccatgacaacaggaactgtgtcttgaccactgttgacttccaagcacctcaaataggacctgtcacatagaagtttcaatcaatatttgttgagtgaatgaagacaacaggtgtcaacttagcttctactacagttctaagacttttgcgtcaagaagtggggacactccagatgcaatggtgaaaagccacgattatttccacctggccctttctcctatctgtcccgctatctttctgttacttgctcatttctcccaagatctgtcccttcagaggattctttgactccactccatacatttattcttccttgctgtgctcttgctgttgcatcttactgttccctcttcattctcagctttccaaaatcttactcctctttaaggccagaacttattcatccttcaagggctaactgaaggctctgtaaccttgtttgtaaaatcataccaggtgaaactaatattccttttccttggatcccagaaccttttcttgatagtttgattaaggcatttttacaatctgatgtaattaagacataaaaaaggacaaaggctctatcctccctggaagatagggaggttttttggtttgtttgtttgtttttgcttttgttttctttttttgagacagggtctcactctgtcactctgtcacccaggctggagtaaagtggggcatgatcacagctcactgcagtctcaaattatgagctccagcatcatccctactcagcctcctgagtagctgggactacaggcacaagcctgtctaagttttttcttatttttttaacagagacaaggtctccatatgttgcccaggcttgtcttgaactcctggcctcaaacgagcctcccgcctcagcctccctgggattacaggtgcaagccacagcacctggctaggattcttacaggcatgaatgaagtgctggtatctctagtaatttgcacataacaaatgcccaattaatgtttgcttaattgaataaaattgacattattctctgagaattaggtggggaaaatgaaatgaatttgaatgtgtgctgtatgctatacactgtggtaataatgcgataatatactttatttccaaaaaccctcccagcaatcttactgaagtgtattaccatccctgttttgcagaggatggtcagagaagttatgtgagctgcccagggttacacggctactgacaggcagaaccagggtttgaagtcagatttatatatttaaagacaaaatggcttatactcattaaaattatttttatccctacagattcaagatgggattctagtagacagcatagctacacatcaggcatagatttggaagcctggttttaacatgccaaagggtaaataaaagccatgtgtcctttctccatgaggatgagaatacttttatatagtctttttgtgtggagagagtctaaactacacagagaactaccccaggtgaatcaaaacaattgactacggtgaggtcacataaattagtgatacctagttaactttttgtcttgaggccagagctagtgttggctcacttgggacttgagaaggcaagagaggtatttatagcaacagtgacagctgactgcaagtattcctatgacgattaaatttattctaggaaatcttataaatagtgagtttaatagctgtcactttgagttcatcagctgaagcaacagtttagaattcatatttgaaaacctccattgaagctaaaatgtagaaaaatagagggctaccctggtgtggtatctcagggcaaatgtagctcactgaatttagcttggtccctaaagaagtaaaactttacaatagttaagtgaaccaaaatctttgccatatcaaaactaatcgtaaaaaggcatctttccaatggatgcagcttgccgtttaatagaatatatcagagcatgaaaattgtcctttaaagcatgtccactaactccttcttcaactaaatgcctccagagagaaaatgaatgcattctaaaactttcatgctttttttccccagaaaagctgattcccaaaatatctaacctataaactttgaacaatagcaacccttttaaaaaccctaaaaaactatataaagaagggctggatggagctacatttatatatttacagttatttgtttttcttaaagttttcctcttgatgataattaaatttaaatgtttttttcatagaaaatctggaaaatacacaaaaattaaatagagaagaaaaaagaaaaagatttttgccccactgctcatagaggcaatcatggttaacgtgttgatgtattttcttttccctaagcttggttttcatagtccttggctttgctgttatttatttgctcatcatttgttctcaacagtgccaacgacctcacagacacaggttgtggatagcagcagacatggaggtggaggctgggcggccagtgatgctgtgagtcaggtgagtcatttctcatctctaggccagacgttttcacaggttggttctcagaatctgagaaaagcagcagaccctctttccacaaatatccacaatagacccacgctttgcatacaagttcagggcccacatccaaatcccttagcgatccaggagcctctcaggttaaacatcttgaactaggtatcagactccttgacagtttgcaatgctgccttctcaaagaagcttgcaaatgtctccatttattatttgagtcaatgtgagttgtacgtaaagaaagaatgaggagaaagccctctcagatggtcatctgggcctttctactacaaacagccttgctaactctgggaatctcaagccatgctataggaagtggggaggaaagtaggcttctgtgcatgatcccaagtccacactgccagagacatccagatgagcacagtctatttgtgctggggtcagtggagaagaacctgttagtcaaggctcaaggaaggctttgttttttctgtccctgcacaatggtcctgattcattacgtgctctggcatgcagttggtgtcacatgggtgtgatgaccacctctaggttctgatcacacagggtccagaggaaccagagcaatgactggatctgagaggcaccagcttcccaaccatcccaacgcactgtacagtaactgcacacccccagccctgccactcccccgtccccccaacatctccttccctagggacacagctaagctaacacaagataaatgcaaacaacaagctcagtcaaggacagagccaggtgctggcaggcagggcagagggtttagtgcagtcagctggggacccaggggtgactgatgtcctgcaaataacttctaattgtaagtctggaagggaggatgcaatagaaagaaatgaggaagcttctactcactgaccacgtactgcaactagtgctatgtgtatagtaattctattgttcaagcttttcaataaacattcaaggtaggtattgttcagccattgacccaacaatattattggctggtggctctgtgccagaccatggggagagcagaagcaaactgacccaagttcctgctgccatggagcttaccttctaatgggcaagcattcaggaaagaattgggcaaatgcgtgtaagtgatgacaggtgtgagtgcaccaaaggaaagctgagctgctcggtcagcgagtggcaggcagtcgagaaaggcctggggagtgagggagctgtggaggtgtctggggcttacccctctgcccccaggcatggggagcagtcagtgcaaaggtctcgagaggcaggctgcctgatgttgagggaggccagcgcgactggtgtccagttagaaaggggaaggtgtgggtgttggggcttaggacagatagttacaagccacactgggcactttgcacattgtgctgagtaaggaatgagatagtgtgttaatctgtattgtgttgctctaaagaaatacctgagactgggtaatttataaaggtttatttggttcatagttctgcaggctgtacgggaagcacggcaccagtatctgcttctggtgaggactcaggagcttaaaatcatggtggaagcagggagagcaagcatgtcacaaggtgagagaggaagcaagagagaagtggagaggtcccagactctttctaacaaccagatctcacatgaattccttactgctgggagggcagcaaactatgcatgaatgatccatcccatgacccaaacacctcccagtaggccccaccttcaacattgggaatcacatttcaacatgagatttggaggggacaaacatccaaactatatcagatgggaaccgtcagggcagttgagcaaagacgtgacaggatttggcttccattatgaaagcattgctagggacactgggtggagaattagaccacagaggggtcagaaagcaggaggaaaatcaggaactccccaccccccgccatattcagatgatgattctcagctcacaaatgtgcctccaaaatctgatggcaccatgaccctctcctggatcctcgggtgacttcgctctgcctttaaatggaacatatacacgggcagccacgagatcctgcacgttctgcaccagcctccctctgcattgccttgctaccatggatttgccttctgttctctctctctcttacttggtgattccacccgagaccgtgtttctggtacttacctggcccgtgtgcatttccctgatgcctgcgatgttctcctccacttctttatctggctaagacctggtcaccttaaccatcttcaaccttctgtttctcagggaagccactcctgcctctcgcagaccagcctgggtagggcttcgtacagcctagggttccccccctactttggtcatactgctcacttttgggagtacctgctctttttggtctctttctttgggctccagtcaccaaggccaggtcaacttctctcttgttcacccgtcagcacttaagccaagtgcacaatcccaaaaacctgatggcaccacgaccgtccggaatatctggacccttgacaaggaatactttgtgaggtgaacagaatacttgccaacatcacacagctactaagcgggcagatcaaggatcaaactcctgcttccaacttcttcctggcccctggaccttaactcaaggctcagtttagcctcagctggtgacagctggtgagtaagacattcagtttttctgggtctcggttttcccaactattaaatgacagggttggatgctgagttcatttccagggctccaggatctgcaaaggctcccccagtccatctgaccacaagaattacccaggcctggggacacttgtaagaatactcacctgaacctgcagaatcacagctccagaagatgaacctgggattctcattctgtttatttgtttgtttattcaagggtcccaggtgaatcttatcaccaaataagttttggaaatacatttctaagggactccttcccaaaggagcttccca

SEQ ID NO: 268 - DNA, 524 bp, Homo sapiens
aagagttggtgatgaagtttgggcagaaatcccctgtcggccgtccgctccacgcttccctcggggccgacactgccaacctctccgggcactgaggacacctctgcgccctggagcggtgggaggacgcggagcgccgttctctggcttccgacaccctgcccgccctctctagtgggtctgtggctgcgccctctcgaaggaagtaataaatctttctgaccttgggggtcagaggagacgcttcagttttccggaggggtgtgcgggcgggaccgtctttccgctttactggacctctggccggggctgctcttgtttcattgtgccccacatgcggagccccgatgctctccgcatttccgctcgcggtgctgcgtccactgtgattgacgtcctctggaattggggtgatgggggaggggaacgccccgttctaatttgcagaaaaatacttgtcccgcttcttggttttgtagatgagatcaaagaacttgaccccaaaggaaacaccgttgttgaaa

SEQ ID NO: 269 - DNA, 557 bp, Homo sapiens
aggtccctctaagcacccagtcatcaggggcaggcccccatggagagaacaggcttgtttcagggaggaattcccagaagctggagctccagacagaggtgagggacagtggtcagcgcaaggcacactggacagagctgacttcagtcctatctggtgggttcataactcatgaatcatgggaaactgaggggaaagcccaggggaaaattgaaataattttcaaaatggttcaagaccactttctaattgagggtagcaaaagatgcagcttctactgttgggaaggtttggcagggagctgtggaaagaggtgacagaaactaagtctcttgtttctctgcaggagtttctccaagaagcttcttcctagaagctcatcatccctactcactttggggtgaaaatagctttgcaaaacctgctcagatgagtcagcaggccagacctccagagcggtggatgtagtccacacgaaattgcctttagtgaactgagcattgatgttataccatttgattgcattgatttggtttataagaaccagcacatcccta

SEQ ID NO: 270 - DNA, 654 bp, Homo sapiens
tggatcccaaagtttgcagaattagccagcctttgtatgaggttaccaagggggcggggaccgggaacttttggaatgcggatcccaacaacagcaagtctttcatgagttaaaggaaaaacttctggctgccccagccctggggctacccgatctgacaaagccttttccattgtatgcatcagagagagaaaagatggcagctggactttgatcctaaactgtgggtccctggccgaggccggtggcctacctctctcaacaactagacggggtttctaaaggatggcccccctgttggaaggccttggcagcaactgccctgccagtacaagaagcaaataagctgactcttgggcaaaacttgaacataaaggcctcccgtgctgtggtgactttaatgaacactaaaggacatcattggctaacgaaagccagactcaccaaggacgaaactttgctctgtgaaagtccccatataaccattgaagtttgtaacaccctacaccccgccaccttgctgcaggtatcagagagccctgtcgagcctgattgtgtagaagtgttggactcaattgactctagcagacctgacttccgggaccagccttgggcatcagtagactgggaacgatatgtggatgggagcagctt

SEQ ID NO: 271 - DNA, 6575 bp, Homo sapiens; identical to SEQ ID NO: 267

SEQ ID NO: 272 - DNA, 404 bp, Homo sapiens
gtagcccacttccactatgtcttatccataggagcagtgtttgccattataggcagcttagtcctcagattccccctattttcaggctatacactcaatccagcctaagccaaaatccacttcactattatatttacaggtgttaatttaactttcttcccacaagttttctttggcctctccggtatacctcgatgttactctgacaatcctgatgcaatatctgcatgaaatattaccttgtctctaggctcatttatctcactaacagcagtcatgttaataatttttataatctgagaggcctttgcttcaaaacgagaagtattaataattgaacaaccatctactaacctagagtgactttacagctgcccgccaacttatcacacatttgaggaacc

SEQ ID NO: 273 - DNA, 537 bp, Homo sapiens
cagccactgaactaattatattttatgtcctctttgaaaccacacttattcctaccctaattatcatcacctgctgaggtaaccaaacagaacacctcaatgcaagctcatatttcttattctatacactagtgggatcccttcccctacttgtcacgcttatctatactcaaaatgtctcaggttcactaagtatgctaataatgacgtttaccaccgaagaactattaaatgcctgatctaataacattatatgactagcatgtatcttggcttttatagtaaaaatacctctatatgggcttcacctatgacttcccaaagcccacgcagaagctcctattgccggctcagtagtacttgcagcggtactcctaaaactaggcggctacagtatcatagggcttacccttatcctcagctccgtaacagaatacatagcctaccctttcctcatattatccttatgagggatagtcatgacaaactcaatttgtctaccacaaaccgatttaaaatcactaatcgcttactcct

SEQ ID NO: 274 - DNA, 1593 bp, Homo sapiens
cacaataaaattcttgatagcttaatcttttggaaaaattaatgcttgagacaaaggttctttgtgaaaatataaataaactgctttttaggatctcttcagtgaagctgggaggaatatttggggggttgctaaggtgtcattccaaacttttcagtgttcttcaaatctaataaaagaacaaacatctttagtgtattatacaaaaggcctctttgaatattaatggagtatttgtttggtcactccacacattcattgccaggatctgtcctttgattatgatcatgggagatataacagggcatcataggatatataggaaatagattattaatttttagagaaaaatttggagctctccacctcttcttgtaagacaacactcccagctttccattactttaggtaataatgttagattgaaagtttgggactcctgaaagcatctgtcttaaataactggccttatcatccggttcttaagtgagtttagcttattccatagcatacattacaataatttataataaagctgctatatacaaatatgcactaatatacttgtaatttcctgtaaattgatcctatacttgtttcctagatgtttccaaacagctacctacaaaactttggttttacatgttgcctcaaaaacaaaatgtctaaaattcatatatttactgttcttattctccctttttttgtggtcaaaacatttattgtttcttttcctattggatcatatatttagataatcagttcttctattacatttatctttttcattaacctttagctaaataaatccagattaaaaatagtcttttctcatgaaacttaacctgactaaccaattgcagtgaccttttatttattcagtggttacccacattggctacagggagcttttaaaaaatatgaaaggtaggctgggcgaggtgcctcatgccgaggcgggtggatcacctaaggtcagaagttcaagaccagcctggccaacatagtgaaacatcggctctactaaaaatacaaaaattagctgggcatggtagcggacgcctgtaatcccagctactcgggaggctgaggcaggagaattgcctgaacccgggacggggaggttgcagtgagctgagatcgcaccactgtactccatcctgggtgacacagcgagattctgtctcaaaaacgaaagaaagaaagaaaggttagccctaactcctactcccagaaactgatttaattggactatatgtgaatccgtaaaagcttcctgggttaatgtaggggtgggttgcccctccacacctgtgggtgtttctcgtaaggtggaacgagagacttaggaaagaaaaagacacaaagacaaagtatgctgaaccagcgttcagcatatggaggatcccgccagcctctgagttcccttagtatttattgatcattcgtgggtgtttctcgaagagggggatgtgtcagggtcacaagacaattgtggggagagggtcagcagacacgtgaacaaaggtctttgcatcatagacaaggtaaaggattaagtgctgtgcatttagatatgcatacacataaaca

SEQ ID NO: 275 - DNA, 31248 bp, Homo sapiens
tgatgaatttgtgtgtgttgtggctgatgtgcattttggtgctttgtatgcaagtttaagaatatcttagcaataggaaaggaagatttatggcagtttaattaatgaatataatgaaggctaaaacttgtagataaatttataaggtacacaattatttttatagcttatttttagcacaaaggtgattgtattttgttgctttaagaaaggacctcttgataatactggcgtgttttatatttcaatgtgaccagtttaactgatatgcaaacaattattttttaagggaaataaaatgaggcagtagtacaacttagcgaagaggacactgtggcagattctaacgactagattaaatttgagctcttatttggcttttactaccaactgactgcataactttgggtcagttatttggctcttttttttttttaatttacaaaattagaatgagaactacagatagtgaaaatatttggaaaagctttttgaagtcccacgtgaaaggcatcagaaaaaagagttgggtgattttttttaatgggaaataatctgatattgtcagtaaacctaaattttttgtatattaatttattttttaagctgttatttaatttcaggtgcttaagagctcttcaatttgttaatggaaagaaacaccatttacaccggatggctacaaagcaaccttattctggtaaaataatctcttaaatccttatatacacagtcactaactgttggctttataaggtcagtagtagcaaaacagccctgtggcagttagaagctcagcatgtccaagatagcactaacggggaacaaacacaaaaaacagcaaacagtttaaacagtaccatttgatttgaatttaacccaatcttaaacagaggactctaaaaaaacaattaccagcaaagttacattaattagggagatcattaggttgtatcaatgcagtttagctatgccttttaaaaagtgaagatggactagaagcggtggctcatacctgtaatttcagcactttgggaggccaaggtgggaggatcccttgaactcaggactttgagaccaacttgggcaacaaagtgagaccatcatgtctacaaaattttaaaaattagctgggtgtggtggggtatgcctgtggtcccaactatttggaaggctgaagcaggaggatcgcttgagcccaggaggtcaaggctgcagtaagccatgattgtgctactgcactccaacctgggcaactgagtgagaccctgtctcaaaaaaaagaaaaagattgaacttgcaggccaacatttatttctgactattgactacttttgaaagagaaagctttggacactaacattctagtctcagaggcctcaaagaagcacagccctgtaaagaagaaaattctgctgggattagcaagagcctcaaggttttgggaacttggaatgccaggctcagtgttccgagttccaatgttgactctgcctgtgagtcaccctgaactagtcactcagtctcttgtgtttccccctttagagaagagctaagactattgacttttcaggagttgcaaaacatgttacaaaaggataggaaagtactatgcaaacatgtaaatatcatgaaatattgggggggtacattttaataaagataagctgcattcttctgataattggaagttgataatctttatgtaaagacagggagattgatttcaaaatagaggttaatgcttgaaattttaattcgaacagtgtaaatttggatcattgtttgctctgttagtcgatgttgcttactgaaaggaaactcttaacaagttgtcttactagaatggcttattttcagagtcagacccccaggctttctagaaatgtgtattaaaatttagtaacctcactttcaattgttgagtataggacactgtggttgggtttctatatatgttgtaaacaagccaaatacacaaagtgaactctctatggaccttaaaaaagtcttaaaaatttttttttgaggatattgaatgaggcacctattttattccttacttttgcaggatagcttgtcagtgccagcttgggtttttgaattctgactttttgctggccatgatttggctgtctcattaataagacaaacctttctaaagtggagctcattgttttttagttcttttaatggtgtggctagcctctcattgttaaagaaaagaaagaatataatttttattcttcgttctttctggcaactttataccctctactaacccacccagtcctgaaatcctgttagtttttccatctgtgactagcatctctcttctgattcccagtaaacgctactatattcccatcattcaaaattaacaactgttattatttttgtcatatcttcttcaatttttttaaagaaataaaacaaaacattgatgataaaatcaagttgcctttgaatattaattccaagtccatttcctccttctgtcctcacttcccagagcccatgttcagtttgtatactttttaatattttatatatatttgtatgtacccatagttaatatgtagtattgttttatggatttaaatatacataaatgttttcttttttagagagagaggatctcattctgtcacccaggctggagtgcatgatcatagctcactgcagcctcgacctcctgggctcaagtgatcctcctgctccagcctctcaagtagctaggactacaggtttgtgccactatgcttggctaattttttttttttttttgtagagatgggatcttacaatgttgcctggtctcaaactcctggcctcaagagatcctcccgcctctgcttcccaaaatgctaggattacaagtatgaaccaccatgcccagccaactgttatatgatttgtttactttctctgagcattgtttttaaggtctagccatgtttttgtacagacacacacacacgtgcacacacacacacacccatctatatatatatattcattatttttaattgctgtctagcatttcttttctttctttttcttttttttttttttgagaaagactctcgctctgtcacccagactggagtgcagtggcacgatctcagctcactgcaacctctgcctcccgggttcaagcaattcttctgcctcagcctcccaagtagctgggactacaggcgcctgccaccaagcccggctaatttttgtatttttagtagagacggggtttcaacatattggccagtctggtctcaaactcccgacctcaggtgatctgcccgccttggcctcccaaagtgctgggattataggcatgagccaccacacccggctatttgctgtctagcatttcatggcataaataataccacattttatcagtccatttattagtgaatatatgattgtttatatttttttcactaatatataggcaatagtttcttagtcttgattcctagatgcaggattgctacattttgaatatgcacaatttaacttttaagagatattaccaaattgattttcaactgttggaaaactgtttccccagatactttccaacacttgtcagacttcttaatctttgccaattttaggggtaacaaatggttttccctgggctttctagctttatttcagttcatcctattcatagttgctggcctaatcctttctaaggacagcactgctcagggccttgcctggtcaaacactctcagaagctctgcactatctactcagtccaaactgccccaagtcctctgcaagcaacctgtcccacctcatctatccatgcccagctggaccagaacgtgcaacttaccactttctcaaactcagcttttacttttctgcctctgcaacttgatcatgctcttctgcattcctgtattgattcaacaaatatttattgagctctttacttcctgccaggtgctgggaatataagggtgaaaaagaaagaccatatctaggcatttatgggacttaacaatttttagcagaggatggggatgggcagaaaataatccagtaaaaaaattgagcacgataattttccatagtactttataagtactataaagaaagtaaaatagaatgttaatgagtttgtgtggaggagtgacgggggtggatgtggggcatgtccaggtgggaactttagaggggcaggtgctcagcgaaggctttacagagaaggttatattccccttgagaccagcagtgtgaagctcattcacagaccagaagtatttctgatcctgagcaagtgcagatccctgcatgtaggggtggcctcagaggatcctgagaggagcagagctgcccttgtggctggcagttggggctaggagagtggtggatgctgtaggagacaaaggcaggcaaagccatgcctctcagggccttgtggatgctctctaccaaagccactgcaggaaaccgtagtttgccctttaaagccctgtaaagccgtgatcaaatcctctcttcataatcattcctgatccagctggctgggcgcgctctttctggaccaccattgcacagtagtggtgcctcttaaggcatttaacatagcactttgggatcatgatgtctgtccttcccatgagctattagaatttgttttcatgttgctgttttgtttctacctcacaagggacaatactttattgtctggaaagaggaaagtagaggaggaaaaggtagaacacagaagaagcctgtcattttttattgagtctggaatgaactgagtttcagtgaaataagctttcctgttgtatatttgagctgattttcacaatggcaaatatgacaaatttaattttccttaaaaattgataagaccagttggagttctaaaagtgattttttctaccccttgaagatcttttctcagaatagcagtctgtaggctgtcacctaaagtgtcctgttttcagtgctgcacctgctctgagcttcatctttttacgaagacgtcatggtgtgctatctgtactgggaaactttccccagcatcagccatctcctgaagataacattgtctgctagagattgtcatgtatgtggattgaatctctttatcttcatggtaagtttggagttgtgtattagacctaccttactggtgaaaagaatgaaggttcgtagaggtcattacttgtctgtccgcaggttacgaaattagagaatagcgaagctgacacttgaatctggggctactgaccaattctctatgaagcttccacactttaagtagtaacatagcaaagaccaagcacttaaaattatttctagatgaagcctttgtgctctgaaccactgtgatcactgttgatcgcattttccttcttgaactcattttctattaataggagcatttatcacagacagtgagaggcagtttgtgcagcggggaagagcacgggctgtctgaagctagactgtctgagtcagggtcttctgtgccagcttgctagctgtgtgggggaagttacttaacatttctgtggttaagtttccttatttttagtatgaggataataacagcacctacctcattgggttgttgtaaggattaaataggataatgtacttaaaaggcttagaacagagccttgtacttaataagtcctcagttaatgctctcctagtctcaggtctcagctcaaatgtcctctcctagggaggccttacctggcccctgtagctagcctgggcctcccccaggcattcaacatcttcaccctctgcctgcaccctgcctacttccctcatggtgttttccctcttttggggtaccaggtttattacagggttgtctcctctgtgacaatgtgagctttccatgggttggcttgtatgttccagtttccagctccaggacagtgcctggcatgtagtttgctctcaatgtacatttgtttaacggctctctgtttctgaaaatcctgaatcagagctttcattttgaacaaaatcgttgctactctggtttcttctcaatatgccatatgtattagtgttccctgaaacttcattcccacagcttcagacatgatcccaaatggctcaagaatttgtacttctagccctgactcctctttctttacttttttttttgagacagagtctcactctgtcgcctgggctggagtacagtggcgcgatcttggctcactgcaacctctgcctcccaggttcaggcaattctcctgccgcagcctcccaagtagctgggattacaggcgcccgccactatgcccagctaattttttgtatttttagtagtgatggggtttcaccatgttggccaggctggtcttgaactcctgacctcatgattcgaccacctcggcctcccaaagttctgggattacaggtgtgagccaccaagcccggccctgactcctctttcaatctgtatttccaactaactgttcataaaacaaattctggtaggtgtccttagcacaacatgttcaaaaccaaatgcactacttttttttttttttttctaaaccaggtcctctttctgtgcccccagcccggttgacaatgtgtgccttcactcacccaattagaaaccttggaggtatcctgtactcttctgtcacttaccctcagcctaaagccaatcagtcaccaaagtattgtctgtcattatcatcatcatcatcatcatcactgtcaccactgatggagtgagaaccttgtgcagttgagcatgaaccccaatttcatttgcaaaatgacccagacagcagatttcatctcatatgaaataagcaaggtgaggttttgatgacgttacagacatggctaagaagaggttgagaaccagcattcagcccacctgactccaaagctcatgccccgaacctcagaaacttctccagtgagttccttttttttaatggcaggatcacaccattagtttggactggatccaacctggattgttgcaacagcctttgatctgatctgtcaagccctgtgccttctgtgcaacccattctctaccctggcacgagcattactaaaataccaatctggtcctatgactcctctgcataaaaaccacggctggggctggtcaagtgcaacagtgtttacaactaattgatcacaaccagttacagatatctttgttccttctttagccaaaaacaaacagaaaaacaaacaaaacccaaataacaaaaacaaacacaaaaaaccccccattgtttgttcccttttgcatcttttgaattctaaactcctcacatagcataaaatccccttctgggtcttttcccagcctacaacccacttccccacctgccccattccccctgttgctcctacctctggccttacttcagccccagggtcccctgctggacatggcaggcccagcacatgctgccctgggccctttcactttgctttgtgacatatttttcatccttcaaccttcagctcataagccatattctctgtgaaggcatccagagggcccgagacagcccctcccacctgtgttcctcagagcattctgtgcccataattagggtgaacacatttctgaatcagcagtggaaatgtttcagttcagacagttacgcatgtgcccctgaaggcaatgggacagttaatagagcaaagtccagaagaaactcttggagatgattcctctttatctgtctgctaccctgtagaggggtggggaaggtacttccagggtagagagctgtgggtggcccttgtatctcttggagatgattcctctttgtctgtctgctaccctgtagaggggtggggaaggtacttccagggtagagagctgtgggtggtccttgtatttgcccacacctgacacgatgcctaactgttgtttgctgaatgtatgaagactatgccaggcctgagattcttttgaacataaccaaatgtcatgtgtaaatttctccaaataaccaaccaacaaacccagctctttataacaatggacaatccagcatgagtattaggactctgtttaagtctcaggtttatcactagaacaattctcatagacacacttcttcatctgtaaaatggggataatagtagctacttacgggagttgcagtgaagactctgtgaatgaattgaaggaaattagcaggcacagagtctggcaaagaagtctttgtttcaggcacaaagatatgtgtagctcatcactataaacaggaactagaaggcaaggtcatgttctagaataacttttaaaagttaggatattgttgggaattttaaaaggtaagacaattaaaaatatgactaatatttgtcagctttttttttttttttttttgatacagagtcttgctcttttacccaggctggagtgaagtggcgccatctcagctcattacagcctctgcctcccgggtttaagcgattctccctcctcagccttcttgagtagctgggattacaggcacccgccatcatgcccggctaatttttgtatttttagtagagactggggttcaccgtgttgttcaggctggtcttgaactcctgacctcaagtgatccacccacctcgacctcccaaagtgctgggattacaggcttgagccactgcgcctggcctcatttgttagctttaacatatgaagagacatcctcctaaatgttaaagtactctttgacattttacctatgcattttacagttgggctgggagagatgtgactcccggtttgttttgcctcacctttgcatttcatcagctgtgtctgatcccagcctagcctgtgtgtcggaatcacttggatgagtgttttacagactcctgggctctaccccaaacccactgaatcagaatggggacaggaagggaactgtaaatctacatttatgaaaacctccccttgtggttttgatagtctgcaaggtttgggaatcactagttcccaaacacaccagtagaaaagcatatagtaattaacattctcaatttctcagctttacagtgtttgtaattaaaaatttttatttgcttttttgtaagcaatattagctttctcaatgtctgtttcaccttcactgcagtctgtttatccagcctgggaaaaaaactggctccacttaaacaatgagacaaaaaaggtgcaaacctgacagcttccctaccttttttgcattagcgtgtaggtatttcctccatgtcctaccagggccatttaaatgctaatatagttaagtacaacaatctttttagcaatcagatggaattgttttttaccacaatcttatttctcatttctccagtccgtacttttccttttttggggcagggtgggggtagggctagaggggcatacatttaaattctttgacctttcaaaccttaacaaaaattctctcctaatatcttctcagcagttcttgcaatgtgtgtatcctctaaacctgagctctgtaatttgaatgtgctgagtcaccttgtctttgcagggtcaaacattttgcatccaggaaaagtactgcagaaaatcacaccattagcagctagctggtatgttatttgaatatttgaatacaaataggaagactggaaaggagaaagttactgtgtacatagatacatagtaacttacatatacttaaaacaaccttttttttttttctaatagtctgctaagtcctctttctgattgatgacttttttgtgtgtgaaattctctaaatatttatttgtgttcctagaaagtgaaaatgaatataaatggtaaagcagttgccttgcaatgtttaataaaaggagaaaatagtctttgctattatactgaagctttgcataattaagattcttgaattaattttaaagaattaataacaaaaaaatacaatcatgaaccagatattgagagttaatgtctaatttaagttcaacttttagggagtccgttttcctattttgatcatgtagttgaatagacagtgaggagatgttactacaactgtattaatagaggaagtggcaggaagctacagtttccttagaatcagaaagaaagtttatagaactcactggaaatgagggttatagataaagattgaagtaggaataacttctatttagaattgctattgtatttttgtaacataagagtggttttctttaaagtaagtatttggggctaaagagaatgccaacactccactcacagggaagtcggaaagcttaccagtattaacaaacatccgaagtcatttcacaaggtggaagtttactatagaaccagtaaacataatcttcctccagggtgttttgagtcatgaatggggagcaacttgctcccttcgtggatggagcactggggacaagcttctctgcatcagagcctgtgaaatatcaatagcaacagctactgtactctgagtgctcacttcctctatgccagaggctggctctggtctttaattgaattcgctcactatacagccccctatacagaaggaacgctaattttcaataccttaaagaggccaaatcattcccacagcattagtggcagagggggtatttgaacccaggcagaatgactcgaactccctggtaattagccatggtggagaatgtctcccagctcacaaaaatgactactcactggcaagtaacactaagtacagaaagaatgtcatcagttggttggtgttcttgctttctctccgtgaacaattaagagggcgcagaggtgagatggggtggggtgggataaagggaaggcctggaagaagggacagaagggctgcaaataatcacccgggagcccagtgagactcagagaaagattctaacctaaaatactcttctgctgtcagctattctgtaattaacatccacagatgaaaacatgaagtgtattaaaaatcctttgtgttttttttcaattttgactgatggacataatataatgacttgataattaaaaaaaaagaaagaaagaaaacccacaaaacccaacaacccaaaattctaaactaactgcttttcatcattctactccctgattagacatggaattgggctcgttactacgggtagaacaatggcctgtgttgggcaggacaagggcatggaagctctccagcaagcagcacagtgggacagcacaggcttctagcaggcatggtttcagtctcaattgtttacaagccttgggatctggaacaattgatttgagccctacaacattagaatggttccttttctcagggcctaatatggggtcagagaaggcactcagcaaggagggttttttcagaggcccaggaagaactagttcagaggccgagcctcctgggagaacacgtagatgagtggggtcaggtgcctgtgtctgagatctagctcaggtcagggcagttttcattgagaaggtgacatttgaacaaagatttgaagttgctgagtgagttagccatgtgggaatctcaatagaagagatttccaagcagaggaaacaactaaggagaaacaggaaattgccttctggcaagatgtaggaacagcaaggaagtaagtgtggctgaaacagagtgagtgaggggtaaagtagttgaaagtgaggtcggggagtaagagagtcagactggccagcatcattttaaggactctgagttttaactatgagaggaacatggagccattgcaaagttctgagcagaggaggacatgtgactgagagtttaaaaagatggctctaagccaggtgcaatggctcatgcctgtaatcccagcactctgggaggccgaggcaggaggatcacttgaggccaggagtttgagaccagcctggacaacatagcctgacctcatctccactaaaaaagaaataaagctgggtatgctggttgcgtacctgtagtcccagctactcaggaggctgaggtgggaggatcacttgagcctgggaagttgagggtgcactgagtcatgatcatgccactgtactccagcctgggcaacagagcaagaccctgtctcaaaaacaacagcaacaacaaaaatctaaaacgattgctctgattgctatattcagaatagactgggtttgaagcagaaagaccagttaggagccattgagtaatccagacaagagatgatgatgggtctgaccagggttcataacagtatgagggtgagaagtgggcagattctggatctatgttgaaggtaaaaccaacaggatttatccctgggttggatatggaatgtgagtggaaaagagaacgtgaggatttattccagggcttatggcatgagcaactggaaggatggcattgccaatacctggggtggcaaggatatgcagaggaaacagatttggggggaacaccaagggttcatttttgcccatgttgagtgtgagatgtccacttgatatccaagtggagatcaaatggaggagagaaaggggtctggtctggtgatacgcttttagaaattaccagtatataaatatttaaagcccagagacaaagagatcataaagggagtactgacagagaagagaagggatcagcagactgagctttgaggtgctacaataactgagagttctagaaaaagaggagggagccccagaggggacttgaaatggagcaacaaatgaggctgtcttgaagatggcattcaccaggcagagagtagggaaagaattctaggtgaggggaagggtgggtacccagactcagaggtacaaaagcctgatctgggagagggacggggaagatagtaagtggtgtggtatggggaagagtagagtagaggctgcaagatgggcttctttgacatgtaagggacttggaccttcaatggaagactttgggagttaatttcttgataattatgaggaagttgatggcagctaagactcattgacgtattattctaacttattattctagcatgtgtcaagcactgtgctaagcaaattacatacattatctcacttaatctttacacctaccctttaagaaagatagtagtattatcctctgcagatgaagaaatgggctcagggggtcaaagttatcagtgagtaaactgcctttaacccaggtagttccattccagagtccatccttttaaccactaacctgtcctgtctccttgaggtctggcacttcttaaccaggtctcagagggtcagcctgagagcatgtgtcatttccccatagaggacctgacttcactgtttctcagatgaggtgctttacctgcaaagggttaaggtagattctgggcaccagtgaaggagttcaagtggaggagcaacttgacaggatttgcttgtgtaggatgttgatctggcagcagtgtggtgaacagagtgcatgagggtgcctgctagtaagggagatctatttggggaagattagctcaatgtgagacctattgaggggcctgagggctgatgaagcagtgtgcttcaggctgcagggtcagggtcttagtaagagatgagctagatttgagagtcacgtggctgcaaatagaatcagtggttctgagggagggaagcaattttcagatattcactgtccatatatacacacttttctcaaatggatcccttagagaacagggaaaatgcacacctcttgcacttccatcatcttcctatggtgtgtttgggaaggtaaaaaaaaacctccgggacccaaacctaggtccaatttcaaatataatgcatgtaggagaatgtgaatgactcagggccagtgacacttccttttacaagtcagatgagtctggctgttcgctttcaacatacttgaagggagacctaaacacacacacacacacacacacacacacacacacagacacacacactctttagagatagggtcttaccatgttgcccaggctggagtgcagtggctgttcacaggtgtgatcatagtacactacagcctggaacttcaagtggtcctcccacctcagcctcaaagggtgtgggattacagttgcacaccactgtgcctggctgaacataaggatagattacaacgtgatttggggctatgactttcaaggatttcaaagatttgagtgacattgctgtagctaaaatacttccattcttttatttatttaaaaataatttctcagttattgtatctataaaaagaacagtagtgatataattataccaatggtttcattataataataagtcatccacaaacccattaactaataataggaaaataaacccagttcatcgcattaatctcattaaagaatgtatttccaataaaactttatattgaatgattgtcaaagtttataatatacttatgatgttttgattaattgtgtactatgaataactggaatttactactacttaatccagaggaatttttctttgtctacctagaggattatggtcacaattttttttttctattttaaatcttaatttatgtccatagttttgtggatgagatctatgaatgggttattaataaaaggtttttgtttgtttgtttgtttggtttttttttgagacagagtctcactctgtcatccaggctggagtacagcagcgtgatctcagctcactgcaacctccaacttccaggttcaagcgattcttgtgcctcagcttcccgagtagctgggattacagatgctcgccaccatgcccagctaatttttgtatttttagtagagatggggttttcccatgttggccaggctggtcttgaactcctgacctcaggtcatccgctggcctcagtttcccaaagtgctgagattacaggcatgggccactgtccctggccaataaaagcttttgaagcataaaaacaaatttcatttataattggtgggtaaaacaaaaacttgcatccaaatgtttgtagcagccttattcataataaccaaaaagtggaaacaattcaaatgtccaccagctgatgaatggataaacaaaatgtggcatatccatacaattgaatattattggacagtaaaaggaatgagtactgattcattccacaacatggatgaaccttgaaatattatgctaagtaaaagaagccagtcacaaaagattacatattatatgattccatttgtatgaaatgttcagaataggcaaatttatggagacagaaagtagatcagtggttgtttagggctgtagtaggggaggggacaatgaggaatgagtgctaatgggtactaggtttatttttggggtgatgaagatgtcttaaggctgattgtaccaacgattgcagctgtaaatatgctgaaaaccattaagttgcattctttaaatggataaattatatggtatatgttttgttttgttttgtcttgtttttgagacagagtctcactctatcacccaggttggagtgcagtggcgcagtctcagctcactgcaacctctgtctcctgggttcaagtgattctcctgcctcagcctccccagtagctgggataacaggtgcacaccaccatgcctggctaatgttttgtatttttagtagagatggggtttcatcatgctggccagactggtctcgaactcctgacctcatgatccacccacctcagcctcccacagtgctgagattacaggcatgagacactgtgcacagccagtatgtgttttatatctcaataaggctgttaaaatatctgtgggaggttgggcacagtggcttatgcctgtaatcccagcacttttttttttttttgagatggagtcccgttttgtcgcacaggctggagtgcagtggcgtgatcccggcttactgcaacctccgcctcccgggttcaagcgattctcctgcctcagcctcccaagtagctgggactacagaagtgcgccaccatgcctggctaattttttgtatttttagtagagacggggtttcactgtgttagccaggatggtctcgatctcttgacctcgtgatccgcctgcctcggcctcccaaagtgctgggattacaggtgtgagccaccatacccagcctaatcccagcagtttgggaggccgaggcaggaggatcacttgaggccaggagttcaaaacaagcttgggcaacatagtgagaacccagtctctacaaaagaaaaagtaaaaagttagctggatgtggtggcccatacctgtagcctcagctacctgagagtctgaggcagagaatcttttgagcccaggagtttgaagccacgtgagctaccattgcaccactgcactccagcctgagcaacaaaacaagacctggtctcccccaacctcctcccccaccagaattctgtggagtaagtgaatgaaaacagaagttaaagcagatataagaatgatacaatattctgactataaaagaagatcttgtacatttacaaaacactatcaattcattgcaaccatttaaatttgggattatagctacttgggaggctgaggcagttggattgcttgagttcagaagtttgagactacagtgagccataatcgccccactgcactctagcttggatgaagagtgagccccgtcaagtaaataaataataaaataaataaataaataatttggatgtcaaatcagaaattgcataggagggccgggctcacgcctgtaatcccagcactttgggtggcccaggtgggcagatcatgaggtcaggagatcaagaccagtcttgccaacaaggtgaaaccctgtctctactaaaatacaaaaaattagtcgagcgtggtggtgcacacctgtagtcccagctactcggaaggccgaggcaggggaatcgcttgaacccgggaagtggaggttgcatgagccaagatcgcgccactgcactccagcctggtgacagggggacactctgtctcaaaacaaacaaacaaacaaaaagaaattgcataggaatatgtagttttgtttttgtggggttttctgttttgttttgtttttttgagacaggatctcgctctgtcactcaggctggagagtagtggtgtgatcccggctcactgcagcctccacctcctgggttcaagcgattctcccacctcagcctcctgggtgtctgggaccacaggcctactgccacaaaaccgcctgcctcggcctcccaaagtgctgggattacaagcgtgagccaccgtgcgcagccctgtagtttttattttaggagattcttaagcaaaaaagcctgaagcccagagaattaaatctcttaaagagaatggctagattaaatgagaaaagaggactaaagaaggaaaatttcagactagccgatgtggcaaaaccctgtctctacaaaaaatccaaaaattagctgggcatggtggtgtgtacctgtagtctcaggtatgcaggagctgaggcaggaggatcactttgacctagtctcatttaaaaacaacaaaaacaaaacaaaaacaaaaaggaaagagagaaaattaggaatactagcatctaaagaaaatgcaggagaaatggagaagtaggactagaaccacagaaggactgtttacagctggagggtagtgtcaagcatccctcaggattgtggaagctcaggactcaaaatcatctgtgattggcaattatgaagtctttgactttggcaccacccatttcagtgaattaattgcagtccagcacagagactgatggctgggaacaggagttcagagaggttagaggcgagaatcagagggaggaagtgaagacatcaactgtgaactactttcttgagaagttagaacagaaataatacggcagtagtttggtaacttttgggagaagtggtgtaaaggtagttgttactactttgaaaacgagattgatttgaacataaaccaaaggtaaaaagctggtgagtgagagagaggagggatgctcatttctgttgtatgcaaaatgttctgcaaatcagctagccttggctgtgacccctgggaagccagaggggatgccatcccccttacttcagaattgtggcctttctcttctggtgagctaggaattttattcagtacttctcgggaattttacaaactcttatctaggcagtgagccactatcttgatactcagtttccaaaaccgcttgtttctacagagctcatttccaatgttgccaatgtttagtgctacaacagggatgggggtgtggatggaccaacaggctagctcaacattcttttgaatttgggttaagtgactgatttagggtaagagtggctcccagggccaggcgcggtggctcacgcctgtaatcccagcactttgggaggccgaggcgggcggatcacaaggtcagaagatcgaaaccatcctggctaacatggtgaaaccccgtctctactaaaaatacaaaaaattagccgggtatggtggcgggcgcctgttgtcccagctactcgggaggctgaggcaggagaatggagtgaacccgggaggcggagcttgtagtgagccgagatcgcgccagtgcattccagcctgggctacagagtgagactccgtctcaaaaaaaaaaaaaaaaaaaaaaaaaaaagagtggctcccgaatttcttgggtaggagtaaaaaagattttacggtatttttttttctcaccttagttctttagaattatgctggaaggaaccaattcacctcaaataccaaggaaatgggtgtgatgtagtaggcagaggagtagccttttccatactgccagcagaatggagacagacctgggctcgcacacaccacccggacccaggagtgggtggttcaatgtgtactgttaagactaaagaaggttggccaggcgtgatggctcatgcatgtaatcccaacattttgggaggccaatgcgggcggatcactcgagcgcaggagtttgagaccagcctgtgcaacatggcgaaactccatctctacaaaaaatacagaaaagctgggtgtgttggcacgcacctgtagtcccagctgctctggaggctgagttgggagaatcacctgagctcaggaggttgaggctgtgtgagccatggttgcaccactgcactccagcctgggcgacagagaccctgtctcaattaaaataaaaaagaaggtcatgtgaaagctcactgtgaacaggacttttttttctctgtaggtgcttcattgttacttcagtttacttgaactcatttcattgttttcacactgttatgaaatgctctcaacaataactgcaacaacaaatagagaagaaaggaagtatttagtaatatcaagagagggccgtggttagcatgagacatcttgcgttattcaccactgcaatgagaagaaaaagactgagcaaagggaatttcatccatttctcaaggatttagagagctacatgctccatttgaaggtcacattgtacatggtgaggtcacattaagggaattgacttcctcctctaaatccccctgatctttatatatttctttccatggttttatgctaatactttgaagaactgaagaatgttatgaggtggccagggaatgctatggttccaggtaaatgtattttcaaggtctttggcagtcggtaaaccattttccaggacacactttggtgtaagcatactagtagtaatagtaacaagtattagcaggaaaaactatcttagttttttgaatttatacttaatattgttattgttcttaccttgttttatagctgagatattaagttccctgctgtgtgctgagggcattgagaacccaaagataaagaggacacagcccctctaaaaacctttctagggccctgtggctccttgtccttgggtggaattcaggggccctgtgaacttttataggaaaagattacagttttatcaccctctaactgcaatacagtatttccttcagttatcaatggtaatgacaagccacaggagtgacagctattcccatttatacatatcactactttgaaataatggtagtcatttgatttaccactagatcaataacaaggcacatatggtatgacagccaataaatgtttgaatagtttgataactgtatttcataattagttttctgcatatgcctatgtctattttaccatattttgagaaggctttaggaggcacaaaaaaaggttaagaacccctttctgtttactatctcatgaggaaggctagaagcttcaacagataaaatcagtacaaagtggtgagtggcagctagaaacatgctcaggagctgtggagcacaggcttgagcagagattcagggaaggctgatggagaagattcctgagctgcatctggaatgaagaagaaacagaagcaggaaaaggtcattcccaggagagaacagaacagatcttagggcaggaaatggcctatgtggaaggcgggtactgacagtcagagcttgcttactgtgctaagtcttgggggctcaagaatgaatgagggacctcctaggtggtcagtgtgctcactgttcagaacaatgtttatggggacagggtggagaggggtatagtttgaaaaaggaaattttttttttggacacggagtctcactctgtctcccaggctggagtgcaatggcatgatctcggctcactgcaatgtctgcctcccaggttcaagcgattctcctgcctcagcctctcgagtagctgggattacaggtgtccaccaccatgcccggctaatttttgtatttttagtagagatggggtttcaccatgttggccaggctggtctcaaactcccaaccttaggtgatccgctcgccttggcctcccaaagtgctgggattacaggcatgagccactgtgcctggccgcctttctagaattttatatgagtggaatcatacaccatgtgctcttctctttggtctggcttctttcacatggcataatgcatttgagatttgttcatgctgttgcaaatcaacagttcattcccaatttttttgccaagcagtatttattatagaattatatactctgaaaaggggaaaaaaaccaacctttgttttcataaaacaaaattttaaaaaggagtgagatttttaatgcttatcaaatgggaatatgagttaaaaattgttgagaaatgctgctccagcatgtggtcagagagcattccagcccaagattttcttatgtcaatgctaaatttgagcacatttggaagtattttagacctgaaagaaggcaggacatcaaaacaaccactagagccgagtgggcctttgtaaccacagactctctgacgaaaagatttgtaaagactctgcctaatgaagagttcaaaaagcattttgtgtgtcatctgttttccttacagtctccttacttggtagataaggggcaagaattattttccatgttgcataaataggaaatgaggtatagcgagtttgagatacttattacccaagatcccagggagtcagaggcagactgaggactgcaaaagatccctcctggtccacaatcttagccttgccagtaggctgggctgaaagctttaaaaaaaaatacagtaatttcactttcacttttgttcttgtttgggttgtgatacaatctttaatttgaaagaatgaagggttttcttttccttctttgtttttaaaactttcccctctcttcttggtaaacaccaacatgtgtgttgactctatccagttgaactcaacaacctaatgcctgttttgtgccaggctcttttccaggcactaaggaggcactgatctggacaaatcctggaggttactgtgaagcaggaaggacaaaatgaccaaatgagaattaaattacttttttagggtcgtggaagatttgaaaatctggggaaacatatgtgtcctctttcccccaaaaaatgcacatagtgtgtacacacacacacacacacacacacacacacgtgtgtgtgtgcgcttgggctcacatgattttgcaatgattttagcgtgtttagagaccccccagaacttgtgtgtaggattggcctttggatgagtatttttggcatagaatgaaatagtaatgccttgaaggcagcacaaagccatagtcactgaatagagagaaagattcagaggatcctgtgagatgggtggggctgttagtgttttgatagacacgtgtactgagttgggagggtactaatttctggaaggcaatattccaggcagagggcacatctgagaaaggtaggaggggagggaagcagaaaaatgcaaagcaatctgagaaacccagtttggctggaggatagattatatgaagagcaatcttcagaaacacccatagaaaggtaggcaggggtcatattgtgagtgatactgagtaagcaaggtgagtagtcttctttttattctccccagtaaaatattctgcagttccttttatttttaattagatggcaaaaccccatctctatcaaaaaacacaaaaattagccgggcttggtggtgcatgcctgtagtcccagctacttgggaggctgaggcaagaggatcacttgagagtgagctgtgatcatgccactgcactccagcatggctgacacagcaagatgctgtctcaaaaatatgtatatattatatacagttttctgttgttgtttgtttggtttttttggagatggagtttcattcttgttgcccaggctggagtgcagtggtgtgacctctgctcactgcaacctccgcctcctgggttcaagtgattctcctgcctcagcctcccgagtagctaggactacaggtgtgcaccaccacacccagctaatttttatagttttagtagagatggggttttaccatgttagtcaggctggtcttgaactgctgacctcaggtgatccaccaaccttggcctcccaaagtgctaggattacaggcgactggccttttttttttttttttttttttgagatggagtcttgctctgtcacctaggctggagtgcagtggcacaatctcggctcactgcaacctccgcctcccgggttcaagcgattcttctgcctcagcctcatgagtagctgggactgcagttgcgtgccaccacacccagctaatttttgaatttttagtagagacggggtttcaccatattggccaggctggaggtttttgtttgtttttttttttttgagatggagtctcactctgatgcccaggctggagtgcagtggcacagtctcagttcactgcaacctctggttcccgggtttaaacagttctcctgtctcagcctcctgagtagctgggactacaggtgcatgccaccaagaccagctaatttttgtatttttagtagagatagagtttcaccatattggccaggctggaggtttttttttttttttgagatggagtctcactctgatgtccaggctggagtgcagtggtgcaatctcagctcactgcaacctctgctttccaggtttaaggaattatcctgtctcagcctcctgagtagctggtacttacaggcacatgccaccacgaccagctaatttttgtatttttagtagagaaggggtttcaccctgtcaccatattggatggggtttcaccatattggcctcaaactcctgacctcaggtgatccactcacctcagcctcccaaaagtgctgggattacaggcatgagccactgagcctggccaaatcagttagtttttgctagtaacaattccccctaccactaaaatttcatggctttaaacaatcatatatttagcttgtgattttgtggtcagatgattctagtctgggcagctcagctgggtagctgatgtcttctgggcttgtccccatgtctggagccaaccaatgggttagatggtggccaggtgatccaggaaggcttcccttatgtgtggccactggctaagagccttggtgctcctccatgtttccactcctctagcaggctagcacgggcttattcacatggtggtcttagggatacaaatgcaagcaggagagtaaacccagagcacaggtgaattaaagccactgcttgcgtacatttgcttcacaagtcacatggccaactaaaatgcaggggcaggaaatagactcaactttctgatgggaagaactgcaacatcacattgcagggatgtggaagggagaacttgtggtggtttttgtaaactacctcacctggtcattgaatacattgattccacagtatatgatagatacaggcagctaacaaaaatttggattattggataaattattggccatatatatacatgtatatatgtaccatacttattttgcaaataggcttgaagcctgcctaggaaaaactgagtcttttttttctagcctatcttatttttggatccttatattagtgatatatggagcttaaatattgcagaactagtaacaaaatgttaatgtcaatacctcagaaaagggagttactgaagaatactgaacttaatgtacagttgaattaaataaagatagtagcctaagccaaatattattagactagtgaatgatagaaacaaaaagctacaaagaggtttggtttgcatgttaaaaagtatcctatgcatgaaaccacttcacatctttatgcctcattgtcatttccaattagactactctctagaattatttcacatttccaaaatggttgaattagttgggttacaattccagctgcatacaggattattttacaggtaagctagccatatctgggttacaaaacagtgtcagaaatatggtgaatggtgtttaccattcttgcactcatatatctacacatgcagactaacagtgatgggacatgacttatgcaccaggcattgtaatacagagaaaaatcagacaaaaccctctccctccaggagctcatatgctttgtgagggagagagatacataagtacagttccagagataagtgctagtaaaattttgcagatgatactacagagcctagatttttttttttttcaagatctctctctgtcactcaggctggagtacagtggtgcaatcaaggctcacagcagcctcaacctcctgggctcaggtgatcctctcacctctgcctcccaagtagctggaaccacaggcgcattagcatgcctgtctaatttttttttttttttccgagacagagtgttactctattgcccaggctggagtgtagcggtacgatctcggctcactgcaacctccgcctcccgggctcaagcaattctcctgcctcagcctcccaagtagctgggattacaggcatgcgccaccacgcccggctaatttttatatttttaataaagacagggtttcaccatgttggccaggctggtcgcgaactcttgacctcatgatccgcctgcctcagcctctcaaagttctgggattacaggtgtgagccactgtgcccggccctaatttttaaagtttggagagatagactctccctacgttgcccaggctggtctcaaactcctgggctccagtgagacttccacctcagcctgccaaagtgctgggattacaggcgtgagcccccatgcctgggccagatttttaacattggctttttttttttttttttttttttttttttaagattgagttttgctcttgttgcccaggctggagtgcaatgtcctgatcttggctcaccacaacctccacctcctgggttcaagcgattctcctgcctcagcctcccaagtagctgggattacaggcatgtgccaccactcctggctaattttgtatttttagtagagacggagtttctccttgttggccaggctggtctcgaactcctgacctcagatgatccacctgccttggcctcccaaagtggtgggattacaggcatgagccaccacgcctggcctaacattggttttttatattagtaatgacatagcaagtcactctggaacttttataaaggacatctgcccaggtattaaccctggagattctcattcattgggtatggagtggggaccagatggctgtattttggaaaggcacaaatgatactgagaggtacttctaagaaccattgctttataaaatgttagtgtggccgggtgcggtggctcacgcctgtaatcccagcactttgggtggccgaggtgggtggatcacctgaggtcaggagtttgagagcagcttggccaacatggtgagaccccctctctactaaaaatacaaaaactagccagacgtggtggcgggcacttgtaatctcagctactagagaggccgaggccagagaatcgcttgaaccccggaggcggaggttgcactgagccgagatcgcgccactgcactccatcctgggtgacagagtgagactctgtctcaaaaagaaaaaaaaatgatgaaagataggtttattggtttttttttttttttgagatggagtctcactctgtcgcccacgctggagtgcagcggcgcgatctcggctcactgcaagctccacctcccgagctcacaccattctcctgcctcagcctccggagtagctgggactacaggtgcctgccactacgcctggctaattgtttgcattttttttttttttttagtagagacgtggtttcaccatgttagccaggatggtctccatctcctgacctcatgatccgcccgcgtcgacctcccaaagtgctgggattaggtttattgttttaaagaatagttttattgagatatgattcacataaatgtaattcacccacttaaagtgtaaattcggtggttttaaatatagtcacagaattgtgcaaccatcaccagaatcaattttagggcattcttattgctccacaaagaaacctcgtgcctattaccagtcactccccacatcttctcaactcgtccagtcctaggcaaccactaatgtactttctgtctccagatttgtctctcctggacatttcatataatatgtggtcttttgtgactggcttcttcctttctcgcttcccctccgctcccctcccctccgttcccctcccctccactccactcccttctcccccactcccctcccttcctctcccttcccctcccgtttcctttttgatggagtctccctatgtcacccaggctggagtgcagtgacgcgatcttggctcactgcaacctctgcctcccggattcaagcaattctcttgcttccgcctcccaagtagctgggattacaggtgtccaccaccacacccagctaatttttgtacttttagtagagatggggtttcaccatgttggccaggctggtcttgaactcccaacctcaagtgatccacccacctcagcctcccaaagtgctgagattacaggtgtgagccaccacacctggcctgactggcttctttcacatagcataatgttttcaaggttcatccgtgttatagcatgtgtcagttcttcattctctttcatggatgaatagtattccattgcatgaattaaatgtagtacaatttgtttatctatttctcatttgggttgtttccagtatttgcccaatatgaataagaatgatgctgctggccgggcgagatggctcacgcctgtaatcccagcacttttgggaggctgacgggggtggatcacctgaggtcaagagtttgaaactagccttgaccaacatggtgaaaccccgtctctactaaaaatacaaaaattagctgggcgttgtggcatccgcctgtaatcccagctactagggagactgaggcaggagaatcgcttgaacccgggaggcaaaggttgcagtgagccgagatcgtgccgttgcactacagcctgggcaacaagagcaaaactccatctcaaaaaaaaaaaaaaaaaaaaaaaagatgctgctatgaacagtcatgtacaaatttttatatggacatatgttttcatttctttgggtaaacccttaggagaggaattcctaggcgacatgagaattttgtttcctcttttgagaaactgccaaacttttccaaagcaaatgcaccattttacattccatcagcagtgtgagagctccagtttcttcacattctccctaacacttgttatttgtgattttgattatagccaaagatagattttattatccccatttttaagataaggatatcatggtttagagcagttgtcaggccatagacaggtactttgcactctcagacactggacctcatctgccatagcactttgaaatgaccttataataattgaaagaggaaggccgggcatagtggttcacgcccgtaatcccagcactttgggaggccgaggcaggtggatcacctgaggtcaggagtttgagaccagcctggccaacatggtgaaacctcgtttctactaaaaataccaaagttagctgggcgtggtggcgggtgcctgtaatcccagctacttgggaggctgaggcaggagaatcgcttgaacctgggaagtggaggttgcagtgagtggagattgcaccactatgctccagcctaggcaataagagcaaaactccatctctaaaaaaaaaaaaaaaaaaaaaaggaaataataataattgaaagaggaaaacatggaactatatatggaattgttttcaaatactttagtattttttccagaattaatgggcaatttaatatttcatataattgacttctgtaaatgactggtattccttttttttttgagatggagtctcactctgtggccgaggttggagtgcagtggtgcaaccttggctcactgcaatctctgcctcccaggttaaagcaattctcctgcctcagcctcctgagtagctgggattacaggtgcctgccaccatgcctggctaatttttgtatttttagtagagactgggtttcaccatgttggtcaggctgctctcaaactcctaatgtctagtgatccacccaccttggtctcccaaagttctgggattacaggtgtgagccaccacgcctggccaactggtattccttttataaaatacgtatctgacttatttttgttgcctcattacatcaagatttacatccaagttaaatttgtatagattataggtaatcaagtgtggtaagcacctactgaaatgtttaaaaattttagaatttccttactgtcaaaatgataattcttttttttttttgagaaggggtcttgctctttcgcccaggctggagtgcagtggtgcgatcttggctcactgcaacctccgactcctgggttcaagtgattctcctgcctcagcctcctgagtagctgggattacaggtgtgtgccactatgcccagctaattttttgtatttttagtagagacagggtttcaccatattggccaggctggtcctgaactcctgacctcaggtgatacacccaccttggcctcccaaagtgttgggattacaggtgtgagccaccgcgccccaccaaaatgataattcttaaccagaggaaatagacaaatgaacagaaactcacatggaaaggtttgttccaggggttcacattcatgattgttcatcagacttcagagctttaaaaaatagaatacaggtgcacaggctctaccccagattaagtgagtcaggatctttgtggttggctctggggtgtctgcatttgtaaaaagctccccagctgattctgaggctcagctgaggttgagaatcaatggtttgtgtgactgagatggttggcagtatgaagatgtttttgagaaatttactggcagacctagctgggcatccagcttgattggtctgttgcatggggtggaaaagatagttggggtgggggtatggggtggctttggcaggtgggagatggcagtgcaggtaatgcagaaaaggaatttaagtaaagtagtgtgtgtttttgaagccaatgagaagcttccttataaagaaataatattcatatgctgtaactctattcccacctcaacttgttttgaaaactttaaatctagagagaagttgaaataaaggtacaatgaacacctgtattgtttttatctaggttcaccagttaacattttgctgtattaacactggctcttcctcccaaccccctttctaaaccatttgaaagtaagatgcagtcactgtggcctttgcatttaagtaactgtgaagaataggaatattttcctacataaccataatataattattacataatgaaatttaaccttggtattataccgttaccgaacatacagtctatatttgctcttcatagctctttttttttttttttgattccaggatccagttgaaaatcaggcattgcatccagttatcatggctttaatcttaatgccttccctgcactgttttgggaatatcttaatactgctatttttgaagagtccagctcagttattctgcagaatgtctgttgatttggctttgctgtttcctcataagtagatccagattatacgtttttgttgatgttgggttcttctcagtgaatcacatccgatgatgtcagcacgaggcctgatcatttggtttaggtagctttcactagactttttcattgtaaaggtacctatcccttttctaattaataagtaatatgttgggtgatagtttgtgtgtgaatatccttttctccagtgacctttcatccaatggtttcagcattttaaatgatcctgggctgagtcagttttcagtggtggctgcagacttgtggttttccaattctttcatcacttttacatttattaattggcagtctatgacttcttatagccacataaagataattcaggaattatctgaacctatgaatgttaccttatttggaaaaagagtctttgcagatacaattcaattaagaatcttgagatgaggagattatcctggattatccaatgggccctaaatccaatgacaaatgtccttggcagagggagatttgagacaggagaagagaagacacgaaggagggaaggaagtgatgtgaccacagaggcagcgattggagtgatgtagtcacaagccaaggagcaccaacagccaccaggagctggaagagcccaagagtatatactaatacctggatttgggacttgggacttctggtctctagaagtaggaaagaataaacatctgttttttgt

SEQ ID NO: 276 - DNA, 580 bp, Homo sapiens
aagacaccacatcccctattatagaagaactactcactttccatgaccatgctcttataattattttcctaattagttccctggtcctagacatcatttccctaatactcacaacaaaattaactcatactggcaccatagatgctcaagaaatcgaaactgtgtgaactgttttacctgccattatcttaattttaattgccctcccatccctacgtattgtgcacataatagacaaggttaacaatccttctcttactgtcaaagcagttggccaccagtgatattgaagctctaaatatacagactatgaagagttaggctttgattcttatatgattccaacagcagacttaaagccagaacttcgactccttgaagttgataactgaacaattctcccaacagagatccctgtccatatattaatctcatccgaagacatcctgcattcatgaactatccccttactgggcctcaaaacagatggaatccccggacgcttaaattaaactaccttaactgctacatgtccaggcctttactatggacagtgctcagaaatttgtgggtctaacca

SEQ ID NO: 277 - DNA, 565 bp, Homo sapiens
acatcccctattatacaagaactactcactttccatgaccacactcttataattcttttcctcattagttccctggccctatatattatttccctaatgctgacaacaaaattaactcatgctagcactatagatgctcaagagaacgagaatatgtgagctattttacccaccattatcctgatcttaattgtcctcccctgtcttcgtattctatacttgacagatgaaattaatagcccgtccctcactgtcaaaacaactggccaccaatgatactgaagctatgagtatacagactatgaagatgtaagtttcgattcttacatgactccaacaacagacttaaaaccaggagaacttcgactccttgaagctggtaaccaaacaattctcccaacagaaatccctattcgtatattaatctcatctgaagacgtcctgcactcacaaactatcccgtcaccgggcctcaaaacagatgcaatccctggacgcttaaatcaaaccattttaactgctacaagaccaggcctttactatggccaatgctcagaaatttgtg

SEQ ID NO: 278 - DNA, 402 bp, Homo sapiens
ggtgacaacgtctaatgaagacttttatgatagggatgtaattgtaaaaaaaaaaaaaaaaaaaaaaaaaaagattaaaaaattggtttcaatgctttgccatccaagagttcatttgtttcctcattcatgcactaaataagcccctaattaatcttgaacctcggagaaaggcgactagattgccattttctccgtaaggacgcacttcacattttgggaagtttgaagaggctcttcagcattttcctttagtggtattttatcagcattttagagaagcttcattaggctgccgaaagctgctaattgcattaccatatttttaagcctcacgggttcgggtcagattcatcgttctcccaattctcccacgaatctgcaggtttgacatgtcagaga

SEQ ID NO: 279 - DNA, 598 bp, Homo sapiens
ataaacgtggaaagaaacttgtcagctaatgatacatcttacaacagggcgaattggaatggagggaaaaacagtagttgaagatcatccctgtggctcccaagatgaaagttactggggtggcctgaacttcccagtgtggctcgaaggtgtgtgtggatttttcttgtttgctatacgaaggtttcaacataatctggtgaccatacttttaaccacactgatttatggggaaagatgctctggggccacaattctatttctatttgcacagccttatgtattgattttcagacgtatgctctcagcagaaaaaaaaatattttttttgcagtagcaattaacctaataaaccaccttttcatcgttctgcatgtagattaaccacttcagagaataccagatcaacaccgtgttttgcatgcctgcaccttcggagaggaagctgttatttcagaagccaggcagaacaaagggagtcatctggtgcgatcctagtaattagagagaagaggcccctcaggtgactgctgagaaagctcccttaatttgaccctgtttcacacagtccaattttcaataaaaagagacacttcag

SEQ ID NO: 280 - DNA, 5060 bp, Homo sapiens
atttggaagatgcttccagtcaagtctcaatctcagtcggtcactggtccatgtatatttcatggacatctaccctgtgctgggcactgggcagacaacagtctactggacccagtctcactctcaaggggactgtagtccaagagagaggcaggtagattatcaggtaattccagctcaccacgattgatgggaaggtagggaaagtttgggatacatgcaaggccgtaggagaggcaccccaccggggcttgggggcaggaaagttttccaggagagagggatatctacgtggctttctggcgggggggggggggtcggggagagagagagagggagagagggagagagagagagatgaatgagatctgccaggagtcctcagtgcctggagctccaagggaggaaggctagggagggaagccatgcttgtcctggggccgagatgaggaggaaggggagggtctgctccaggccagccctggacaaggggataaattttgtcttcaccagacactgaattggtcatcctcacctcccaccttacagatgaagaaactgaggctcaaagagccacagcgggacggaggaggtggacccggctctgatgcaggtggctggttcgatggcagactcccctgtgccgagactcccagaccaaatccggaggtcctggagtagagtgggtgggtccgccagggcatggccaggctgcctgtctctggagactcccccaaggaagtttcttgaccttgaggatgataacgcagggcaggctcttgagggctgtgcagggactccctggagagccctgggaaaagcaggtccccgcctgcctgggcctctgcctctgctgcaggggccagcacaggtgtcaggtccccacacatttcatgtccaggccattttcccactctagggccaaggctgggcacttcccagtcagtggcacagctggtactgtggggtctctcgctctgcaaaggttggtttcaatcccaagtgtcactgctggaaacactggccaccccgggacatgtggtcttgccagtccttctgcagggctctgtttcttaggtcccaatcatctgcagggagcactagtccgagatcttccaagatgctgggcaggaacaagcctgctatgctcattcccaaaggactccacatctagataaatgaaggcctggaaggctctttggctctacactagcaaaacagcttacgtcaccctgcctaaagagacagtcaggaaatccccttgttcctgggcgaggagaagctggcccacacggagtgacggcattgagcagatactacccttggctcgctcatggatggggcggggcctgctgaccttgacagcaatcaggggagggggtttggagggaaggggttagctggtgaaggtgagggaaaggactggagttaggacagggtgcagcgaccacatcctgtgacgaggaggcatctgtgacctgtgtgatctgccaggcaggcagcacaagtcattgtactgctactatgcccgctactgagacaggaacaaagagaggctgtttctgcctcttggtgctctccattggacatgtctgctgggcagtgctggcttttaccataggtatttttctgctcttccttccctcctcctctccctctctcttttccagggcactcacacacacacacttgcacacatgtgcacagttgcacacacatgcattgaacacatgtgcacatatatgcgtttgcatccacttgcacacccacacacctgtgcactagcacccatttgcacgcatgtccacacacttgcacacatgtgcatttgcagaaatgcacccttgcacttgtgtgacacacctgcacacttgcatacacccatttgcatacaggcacagacacactcgcatacatttgcacacacagccacaaacttgcacaagcagcacttgtacactgacacatatccgtttgtgcctatacagtgcacacttacacatttgcacacagctgtgcttgctcacacatttgcacacacccacctacacacttgcacacatactacacacttgagcgtgcagcacacatacctatgtgcatacatgcacatttgcacatgcacacagcagtggcacacacttctctatcactctccctagtcactgttctcccctgtgattcccacccctctgaccgcccctgctcacttgctgccccctccactggaaggggcctggcctggtgccctgtctctgtctgtctccaccgtgcagggaggtttcacaaggactggctgatgtctcgcctcgagctggcctggccgcagctgctgctgagcggaagtctctgaggggcgaggctgagaggaaaccacactctcactggggttcccgcagctctggcctctggggaggggtgtggagatgtgtgggcgtgagatggctttgagggagggacagcatgaagcttttcgctgggtctgtcttttcagtctccaggacaaaactaggccactgtgctccaggagaagggaaaacccacgtccccccaggctgggcccaccggcaaatcgggctcccaggcccttctcagcccatgcttctgtctctgccttgtcaggcttattctttggggctttgaagcagcctttggtgggcaaacggcatctcagggaaccctggcctgtctcctccagagcttgtgccttggccctgggcaggggccaccatgggctgttgatgtaaatggcatccccagagttgtgcagtgtgggggcaaccctgaggtatcagcccagccccctgtctgcagcttttgctacccagcccagctccagctctgtctttgtcactgggggtggtgggggaggctggagctcagggacggggcactcctggcagattctccctgccccaggtggaaggggaggggggaagtacccatcctccatcctcctatcctgccagcggggtgggcgctactatgctggggagggtctggctgaataatgatgctgagctcgggacaccagccttctccgtgcacctactgtgtgccaagtaccatcccaagagcattatgggtggtaacttatacaatgactcagagaggcaccgctataatcacccccagtttctgtctggttccagtcctggccacacagctaataagcagcaaatggatttgatctgattttatctgaacccaggcaggctggcccagagcccactgtctaatcattgggccgtccagcctgtcaagactccaggctcgctggcgtcgtacccctctgtcatttcccagggaaacaagctctagcagcacctgccctgtgggtactttggccctgcctccctgcctccctgcctccctgcctccctgcctctcatgataggagccaaagaatggtctcctttgcaggaaaggagctcgacgggggtcttctcttgcaggctctgtcttgcatgtgggtcctgagctttctcattgagtaaggggagggggcagctggttcagtccagcgcagagtggatggaggccagttgaggctttcttgaaaccctaagcccagctgggatcctcggggaaggatccttcgctgggatctgactggctcttccagaggtcagtggggcatgtggctggagcccaagtaggagggaggaagaaatggtggtctgagtcctggggtgaccaggccctgaacctgccctgctgggaccccattccctgactctaggccccctttccccaccacacaggacaccaggctcttgccttaagacaggaaaggaaatgccttatggtgaacaattctccaggtccctattgtggctccaacagatgccagagggacatggcaggtgaccctggtctcctacgaccctgactttacttgctgtcatgaggccaatctcttaccttgacccacctcctgcctctgctttcagaagggcagaagagcgggcctcctctagcttcccagccgcctcccgcctcctgccgcccggcagcgctgggccccccagcagcgaggttcaggaggggaagaacctctcgcaggtgaacaaattgctgcacatcagacacattcttttcaagcctcattttctctccttttcatgctaactttcccactattaaagagcatttttaaaaagaagatgaaaaaaggcagagagaaaagaaggatgaaagtgtgagcgggtatccggaagtccttttcaattgcctgctgctgtgcagggtctgaactaagagcaagaaattggaggatgctggaggggcgaggtttcgtttcagtcctgcctattgggccaagtctggggcggggaaggagaggtgatggaggtgggcctggctgggccctgcggccctggaggctgcccctctgcctgccacccagcccctggcctgtgcctggcacaggaagcccgtcaataatttcttgttgaatgaatgaaagaaaagaaatcagtggatggagaagggctggattcttttgtggggaccttccacgccaccttctctgtggggctctagggctgagaaagaaaggacagatttggcaaaggtcaggcaggggctgggaaagcattaggtggaccaggcatgctacagcaaggccacgcctgcactgttgtcccactggtgacacccatgggtgcagccatggcgggtgggcgcagtttcacatgggattgggggtgagcctgggttgggtgggcgacccccaccccttccctacccctctccccaccagcaggtactactgggtctgcgtgaagataaaagctcaggaacatgccaggaaggtgtgaccatgatgatacctctgagatgaacccaagaagaaacagcagagtattacaaaggggaacaggactcagggtggacttcaagtatcattaaacataatcaaatatttaaaaagttattattgactgggtgcagtggctcacggctttaatcccagcacttagagaggccaaggtaggaagattgctttagcctaggagtttgagaccagcatgggcaacatagtgagaccccatctc
